United States Patent
Haynes et al.

(10) Patent No.: US 10,004,800 B2
(45) Date of Patent: Jun. 26, 2018

(54) ANTIBODY EVOLUTION IMMUNOGENS

(71) Applicants: Duke University, Durham, NC (US); Los Alamos National Security, LLC, Los Alamos, NM (US); The Trustees of The University of Pennsylvania, Philadelphia, PA (US); Trustees of Boston University, Boston, MA (US); The United States of America as Represented by The Secretary of the Department of Health and Human Services, Washington, DC (US); The Board of Trustees of the Leland Stanford Junior University, Palo Alto, CA (US)

(72) Inventors: Barton F. Haynes, Durham, NC (US); Hua-Xin Liao, Durham, NC (US); Rebecca M. Lynch, Rockville, MD (US); Tongqing Zhou, Rockville, MD (US); Feng Gao, Durham, NC (US); Scott Boyd, Palo Alto, CA (US); George M. Shaw, Philadelphia, PA (US); Beatrice H. Hahn, Philadelphia, PA (US); Thomas B. Kepler, Boston, MA (US); Bette T. Korber, Los Alamos, NM (US); Peter Kwong, Rockville, MD (US); John Mascola, Rockville, MD (US)

(73) Assignees: Duke University, Durham, NC (US); Los Alamos National Security, LLC, Los Alamos, NM (US); The Trustees of The University of Pennsylvania, Philadelphia, PA (US); Trustees of Boston University, Boston, MA (US); The United States of America as Represented by The Secretary of the Department of Health and Human Services National Institutes of Health Office of Technology Transfer, Washington, DC (US); The Board of Trustees of the Leland Stanford Junior University, Palo Alto, CA (US)

( * ) Notice: Subject to any disclaimer, the term of this patent is extended or adjusted under 35 U.S.C. 154(b) by 0 days. days.

(21) Appl. No.: 14/427,581
(22) PCT Filed: Sep. 12, 2013
(86) PCT No.: PCT/US2013/000210
§ 371 (c)(1),
(2) Date: Mar. 11, 2015

(87) PCT Pub. No.: WO2014/042669
PCT Pub. Date: Mar. 20, 2014

(65) Prior Publication Data
US 2015/0366961 A1    Dec. 24, 2015

Related U.S. Application Data

(60) Provisional application No. 61/700,252, filed on Sep. 12, 2012, provisional application No. 61/708,466, (Continued)

(51) Int. Cl.
*A61K 39/21*    (2006.01)
*A61K 39/12*    (2006.01)
(Continued)

(52) U.S. Cl.
CPC .............. *A61K 39/21* (2013.01); *A61K 39/12* (2013.01); *C07K 14/005* (2013.01); *C12N 7/00* (2013.01);
(Continued)

(58) Field of Classification Search
None
See application file for complete search history.

(56) References Cited

U.S. PATENT DOCUMENTS

2009/0232830 A1    9/2009  Quinnan et al.
2010/0215682 A1    8/2010  Berkower
(Continued)

FOREIGN PATENT DOCUMENTS

JP       2006-149234 A    6/2006
WO    WO 2004-014420    2/2004
(Continued)

OTHER PUBLICATIONS

Wu et al. CD4-induced interaction of primary HIV-1 gp120 glycoproteins with the chemokine receptor CCR-5. Nature. 1996; 384: 179-184.*
(Continued)

*Primary Examiner* — Janet L Andres
*Assistant Examiner* — Stuart W Snyder
(74) *Attorney, Agent, or Firm* — Wilmer Cutler Pickering Hale and Dorr LLP

(57) ABSTRACT

The present invention relates, in general, to HIV-1 and, in particular, to broadly neutralizing HIV-1 antibodies, and to HIV-1 immunogens and to methods of using such immunogens to induce the production of broadly neutralizing HIV-1 antibodies in a subject (e.g., a human).

24 Claims, 386 Drawing Sheets

Related U.S. Application Data filed on Oct. 1, 2012, provisional application No. 61/764,421, filed on Feb. 13, 2012.

(51) Int. Cl.
  C07K 14/005 (2006.01)
  C12N 7/00 (2006.01)
  A61K 39/00 (2006.01)

(52) U.S. Cl.
  CPC ............... A61K 2039/57 (2013.01); C12N 2740/15022 (2013.01); C12N 2740/16022 (2013.01); C12N 2740/16122 (2013.01); C12N 2740/16134 (2013.01)

(56) References Cited

U.S. PATENT DOCUMENTS

| | | | |
|---|---|---|---|
| 2012/0039923 | A1 | 2/2012 | Broder et al. |
| 2012/0269821 | A1 | 10/2012 | Haynes et al. |
| 2014/0341949 | A1 | 11/2014 | Haynes et al. |
| 2015/0366961 | A1 | 12/2015 | Haynes et al. |

FOREIGN PATENT DOCUMENTS

| | | | |
|---|---|---|---|
| WO | WO-2004-014420 | A1 | 2/2004 |
| WO | WO-2009-058989 | A1 | 5/2009 |
| WO | WO-2011-035082 | A1 | 3/2011 |
| WO | WO-2013-052095 | A2 | 4/2013 |
| WO | WO-2014-042669 | A1 | 3/2014 |

OTHER PUBLICATIONS

Ojeda et al. GenBank accession No. AEI00390.1.*
Dey et al. Novel adjuvantation of gp140 with MF59 elicits neutralizing antibodies against HIV-1 primary isolates. Poster P02.10LB, presented at AIDS Vaccine 2010, Atlanta, Georgia, U.S.A. Sep. 28-Oct. 1, 2009.*
International Search Report for PCT/US2013/000210, dated Jan. 24, 2014, 5 pages.
Falkowska, E. et al., PGV04, an HIV-1 gp120 CD4 binding site antibody, is broad and potent in neutralization but does not induce conformational changes characteristic of CD4, Journal of Virology, vol. 8, No. 8, (Feb. 15, 2012), pp. 4394-4403.
NCBI, Genbank Accession No. AGG 24895.1, (Apr. 22, 2013).
International Preliminary Report on Patentability dated Mar. 17, 2015 and Written Opinion of the International Searching Authority dated Jan. 24, 2014, issued in connection with PCT/US2013/000210.
Adams, P. D., et al., "*PHENIX*: building new software for automated crystallographic structure determination," Acta Crystallogr. Section D. Biol. Crystallogr., vol. D58, pp. 1948-1954 (2002).
Alam, S. M., et al., "Differential Reactivity of Germ Line Allelic Variants of a Broadly Neutralizing HIV-1 Antibody to a gp41 Fusion Intermediate Conformation," Journal of Virology, vol. 85, No. 22, pp. 11725-11731 (Nov. 2011).
Alam, S. M., et al., "Human Immunodeficiency Virus Type 1 gp41 Antibodies That Mask Membrane Proximal Region Epitopes: Antibody Binding Kinetics, Induction, and Potential for Regulation in Acute Infection," Journal of Virology, vol. 82, No. 1, pp. 115-125 (Jan. 2008).
Alam, S. M., et al., "The Role of Antibody Polyspecificity and Lipid Reactivity in Binding of Broadly Neutralizing Anti-HIV-1 Envelope Human Monoclonal Antibodies 2F5 and 4E10 to Glycoprotein 41 Membrane Proximal Envelope Epitopes," J. Immunol., vol. 178, No. 7, pp. 4424-4435, Author Manuscript—25 pages (Apr. 1, 2007).
Andre, S., et al., "Increased Immune Response Elicited by DNA Vaccination with a Synthetic gp120 Sequence with Optimized Codon Usage," Journal of Virology, vol. 72, No. 2, pp. 1497-1503 (Feb. 1998).
Bar, K. J., et al., "Early Low-Titer Neutralizing Antibodies Impede HIV-1 Replication and Select for Virus Escape," PLoS Pathog., vol. 8, Issue 5, e1002721, pp. 1-20 (May 2012).
Barouch, D. H., et al., "Mosaic HIV-1 Vaccines Expand the Breadth and Depth of Cellular Immune Responses in Rhesus Monkeys," Nature Med., vol. 16, No. 3, pp. 319-323, Author Manuscript—15 pages (Mar. 2010).
Bonsignori, M., et al., "Analysis of a Clonal Lineage of HIV-1 Envelope V2/V3 Conformational Epitope-Specific Broadly Neutralizing Antibodies and Their Inferred Unmutated Common Ancestors," Journal of Virology, vol. 85, No. 19, pp. 9998-10009 (Oct. 2011).
Bonsignori, M., et al., "Two Distinct Broadly Neutralizing Antibody Specificities of Different Clonal Lineages in a Single HIV-1-Infected Donor: Implications for Vaccine Design," Journal of Virology, vol. 86, No. 8, pp. 4688-4692 (Apr. 2012).
Boyd, S. D., et al., "Measurement and clinical monitoring of human lymphocyte clonality by massively parallel VDJ pyrosequencing," Sci. Transl. Med., vol. 1, No. 12, 12ra23, Author Manuscript—16 pages (Dec. 23, 2009).
Burton, D. R., et al., "Broadly neutralizing antibodies suggest new prospects to counter highly antigenically diverse viruses," Science, vol. 337, No. 6091, pp. 183-186, Author Manuscript—10 pages (Jul. 13, 2012).
Chen, W., et al., "All Known Cross-Reactive HIV-1 Neutralizing Antibodies are Highly Divergent from Germline and Their Elicitation May Require Prolonged Periods of Time," AIDS Research and Human Retroviruses, vol. 24, Supplement 1, Abstracts from AIDS Vaccine 2008, Cape Town South Africa, pp. 11-12 (Oct. 13-16, 2008) (Abstract Only).
Cohen, M. S., et al., "Prevention of HIV-1 Infection with Early Antiretroviral Therapy," New Eng. J. Med., vol. 365, No. 6, pp. 493-505 (Aug. 11, 2011).
Collaborative Computational Project, No. 4, "The CCP4 suite: programs for protein crystallography," Acta Crystallographica Section D Biol. Crystallogr., vol. 50, Part 5, pp. 760-763 (1994).
Corti, D., et al., "Analysis of Memory B Cell Responses and Isolation of Novel Monoclonal Antibodies with Neutralizing Breadth from HIV-1-Infected Individuals," PLoS One, vol. 5, Issue 1, e8805, pp. 1-15 (Jan. 2010).
Davis, I. W., et al., "MolProbity: all-atom contacts and structure validation for proteins and nucleic acids," Nucleic Acids Res., vol. 35, Web Server Issue, pp. W375-W383 (2007).
Dimitrov, Dimiter S., "Therapeutic antibodies, vaccines and antibodyomes," mAbs, vol. 2, No. 3, pp. 347-356 (May/Jun. 2010).
Emsley, P. and Cowtan, K., "Coot: model-building tools for molecular graphics," Acta Crystallogr. Section D. Biol. Crystallogr., vol. D60, pp. 2126-2132 (2004).
Envelope Glycoprotein [Human Immunodeficiency Virus 1], Genbank: AGG24903.1, Apr. 22, 2013, retrieved from URL: https://www.ncbi.nlm.nih.gov/protein/AGG24903.1 (2 pages).
Envelope Glycoprotein [Human Immunodeficiency Virus 1], Genbank: AGG25274.1, Apr. 22, 2013, retrieved from URL: https://www.ncbi.nlm.nih.gov/protein/AGG25274 (2 pages).
Envelope Glycoprotein [Human Immunodeficiency Virus 1], Genbank:AGG25129.1, Apr. 22, 2013, retrieved from URL: https://www.ncbi.nlm.nih.gov/protein/AGG25129.1 (2 pages).
Envelope Glycoprotein [Human Immunodeficiency Virus 1], Genbank:AGG24254.1, Apr. 22, 2013, retrieved from URL: https://www.ncbi.nlm.nih.gov/protein/AGG24254.1 (2 pages).

(56) References Cited

OTHER PUBLICATIONS

Geall, A. J., et al., "Nonviral delivery of self-amplifying RNA vaccines," Proc. Natl. Acad. Sci. USA, vol. 109, No. 36, pp. 14604-14609 (Sep. 4, 2012).
Giorgi, F. M., et al., "Algorithm-driven Artifacts in median polish summarization of Microarray data," BMC Bioinformatics, vol. 11, No. 553, pp. 1-12 (2010).
Goonetilleke, N., et al., "The first T cell response to transmitted/founder virus contributes to the control of acute viremia in HIV-1 infection," J. Exp. Med., vol. 206, No. 6, pp. 1253-1272 (Jun. 8, 2009).
Gray, E. S., et al., "Broad Neutralization of Human Immunodeficiency Virus Type 1 Mediated by Plasma Antibodies against the gp41 Membrane Proximal External Region," Journal of Virology, vol. 83, No. 21, pp. 11265-11274 (Nov. 2009).
Gray, E. S., et al., "The Neutralization Breadth of HIV-1 Develops Incrementally over Four Years and Is Associated with CD4+ T Cell Decline and High Viral Load during Acute Infection," Journal of Virology, vol. 85, No. 10, pp. 4828-4840 (May 2011).
Guindon, S., et al., "A Simple, Fast and Accurate Method to Estimate Large Phylogenies by Maximum Likelihood," Syst. Biol., vol. 52, No. 5, pp. 696-704 (2003).
Haynes, B. F., et al., "Antibody polyspecificity and neutralization of HIV-1: A hypothesis," Hum. Antibodies, vol. 14, Nos. 3-4, pp. 59-67, Author Manuscript—12 pages (2005).
Haynes, B. F., et al., "B-cell-lineage immunogen design in vaccine development with HIV-1 as a case study," Nat. Biotechnol., vol. 30, No. 5, pp. 423-433, Author Manuscript—30 pages (May 7, 2013).
Haynes, B. F., et al., "Cardiolipin Polyspecific Autoreactivity in two Broadly Neutralizing HIV-1 Antibodies," Science, vol. 308, pp. 1906-1908 (Jun. 24, 2005).
Hoot, S., et al., "Recombinant HIV Envelope Proteins Fail to Engage Germline Versions of Anti-CD4bs bNAbs," PLoS Pathog., vol. 9, No. 1, e1003106, pp. 1-15 (Jan. 3, 2013).
Jones, D. T., et al., "The rapid generation of mutation data matrices from protein sequences," Comput. Appl. Biosci., vol. 8, No. 3, pp. 275-282 (1992).
Junier, T. and Zdobnov, E. M., "The Newick utilities: high-throughput phylogenetic tree processing in the Unix shell," Bioinformatics, vol. 26, No. 13, pp. 1669-1670 (2010).
Keele, B. F., et al., "Identification and characterization of transmitted and early founder virus envelopes in primary HIV-1 infection," Proc. Natl. Acad. Sci. USA, vol. 105, No. 21, pp. 7552-7557 (May 27, 2008).
Kepler, Thomas B., "Reconstructing a B cell clonal lineage. I. Statistical Inference of Unobserved Ancestors [v1; ref status: indexed, http://f1000r.es/z6]," F1000Research, vol. 2, No. 103, pp. 1-12 (2013).
Kibler, K. V., et al., "Improved NYVAC-Based Vaccine Vectors," PLoS One, vol. 6, Issue 11, e25674, pp. 1-13 (Nov. 2011).
Klein, F., et al., "Broad neutralization by a combination of antibodies recognizing the CD4 binding site and a new conformational epitope on the HIV-1 envelope protein," J. Exp. Med., vol. 209, No. 8, pp. 1469-1479 (Jul. 23, 2012).
Korber, B. T. M., et al., "Genetic Differences between Blood- and Brain-Derived Viral Sequences from Human Immunodeficiency Virus Type 1-Infected Patients: Evidence of Conserved Elements in the V3 Region of the Envelope Protein of Brain-Derived Sequences," Journal of Virology, vol. 68, No. 11, pp. 7467-7481 (Nov. 1994).
Krissinel, E. and Henrick, K., "Inference of macromolecular assemblies from crystalline state," J. Mol. Biol., vol. 372, pp. 774-797 (2007).
Kwong, P. D. and Mascola, J. R., "Human Antibodies that Neutralize HIV-1: Identification, Structures, and B Cell Ontogenies," Immunity, vol. 37, No. 3, pp. 412-425, Author Manuscript—27 pages (Sep. 21, 2012).
Ledgerwood, J. E., et al., "Influenza Virus H5 DNA Vaccination Is Immunogenic by Intramuscular and Intradermal Routes in Humans," Clin. Vaccine Immunol., vol. 19, No. 11, pp. 1792-1797 (Nov. 2012).
Li, Y., et al "Effects of inefficient cleavage of the signal sequence of HIV-1 gp120 on its associations with calnexin, folding, and intracellular transport", Proc. Natl. Acad. Sci. USA, vol. 93, pp. 9606-9611 (Sep. 1996).
Li, Y., et al., "Control Expression, Glycosylation and Secretion of HIV-1 gp120 by Homologous and Heterologous Signal Sequences," Virology, vol. 204, pp. 266-278 (1994).
Liao, H.-X., et al., "A group M consensus envelope glycoprotein induces antibodies that neutralize subsets of subtype B and C HIV-1 primary viruses," Virology, vol. 353, pp. 268-282 (2006).
Liao, H.-X., et al., "Co-evolution of a broadly neutralizing HIV-1 antibody and founder virus," Nature, vol. 496, No. 7446, pp. 469-476, Author Manuscript—25 pages (Apr. 25, 2013).
Liao, H.-X., et al., "High-throughput isolation of immunoglobulin genes from single human B cells and expression as monoclonal antibodies," J. Virol. Methods, vol. 158, Nos. 1-2, pp. 171-179, Author Manuscript—22 pages (Jun. 2009).
Liao, H.-X., et al., "Initial antibodies binding to HIV-1 gp41 in acutely infected subjects are polyreactive and highly mutated," J. Exp. Med., vol. 208, No. 11, pp. 2237-2249, 10 pages (Oct. 24, 2011).
Liao, H.-X., et al., "Vaccine Induction of Antibodies against a Structurally Heterogeneous Site of Immune Pressure within HIV-1 Envelope Protein Variable Regions 1 and 2," Immunity, vol. 38, pp. 176-186 (Jan. 24, 2013).
Lutteke, T. and von der Lieth, C.-W., "pdb-care (PDB CArbohydrate REsidue check): a program to support annotation of complex carbohydrate structures in PDB files," BMC Bioinformatics, vol. 5, No. 69, pp. 1-6 (Jun. 4, 2004).
Lynch, R. M., et al., "The Development of CD4 Binding Site Antibodies during HIV-1 Infection," Journal of Virology, vol. 86, No. 14, pp. 7588-7595 (Jul. 2012).
Ma, B.-J., et al., "Envelope Deglycosylation Enhances Antigenicity of HIV-1 gp41 Epitopes for Both Broad Neutralizing Antibodies and Their Unmutated Ancestor Antibodies," PLoS Pathog., vol. 7, Issue 9, e1002200, pp. 1-16 (Sep. 2011).
Malherbe, D. C., et al., "Sequential Immunization with a Subtype B HIV-1 Envelope Quasispecies Partially Mimics the In Vivo Development of Neutralizing Antibodies," Journal of Virology, vol. 85, No. 11, pp. 5262-5274 (Jun. 2011).
McCoy, A. J., et al., "*Phaser* crystallographic software," J. Appl. Crystallogr., vol. 40, pp. 658-674 (2007).
McElrath, M. J. and Haynes, B. F., "Induction of Immunity to Human Immunodeficiency Virus Type-1 by Vaccination," Immunity, vol. 33, No. 4, pp. 542-554, Author Manuscript—25 pages (Oct. 29, 2010).
McMichael, A. J., et al., "The immune response during acute HIV-1 infection: clues for vaccine development," Nature Rev. Immunol., vol. 10, No. 1, pp. 11-23, Author Manuscript—29 pages (Jan. 2010).
Moir, S., et al., "Normalization of B Cell Counts and Subpopulations after Antiretroviral Therapy in Chronic HIV Disease," The Journal of Infectious Diseases, vol. 197, pp. 572-579 (Feb. 15, 2008).
Montefiori, D. C., et al., "Magnitude and Breadth of the Neutralizing Antibody Response in the RV144 and Vax003 HIV-1 Vaccine Efficacy Trials," The Journal of Infectious Diseases, vol. 206, pp. 431-441 (Aug. 1, 2012).
Moore, P. L., et al., "Potent and Broad Neutralization of HIV-1 Subtype C by Plasma Antibodies Targeting a Quaternary Epitope Including Residues in the V2 Loop," Journal of Virology, vol. 85, No. 7, pp. 3128-3141 (Apr. 2011).
Moore, P. L., et al., "Specificity of the autologous neutralizing antibody response," Curr. Opin. HIV AIDS, vol. 4, No. 5, pp. 358-363, Author Manuscript—11 pages (Sep. 2009).
Moore, P. L., et al., "Limited Neutralizing Antibody Specificities Drive Neutralization Escape in Early HIV Subtype C Infection," PLoS Pathogens, vol. 5, No. 9, e1000598, pp. 1-15 (Sep. 18, 2009).

(56) References Cited

OTHER PUBLICATIONS

Morris, L., et al., "Isolation of a Human Anti-HIV gp41 Membrane Proximal Region Neutralizing Antibody by Antigen-Specific Single B Cell Sorting," PLoS One, vol. 6, Issue 9, e23532, pp. 1-10 (Sep. 2011).
Mouquet, H. and Nussenzweig, M. C., "Polyreactive antibodies in adaptive immune responses to viruses," Cell Mol. Life Sci., vol. 69, pp. 1435-1445 (2012).
Mouquet, H., et al., "Polyreactivity increases the apparent affinity of anti-HIV antibodies by heteroligation," Nature, vol. 467, No. 7315, pp. 591-595, Author Manuscript—15 pages (Sep. 30, 2010).
Otwinowski, Z. and Minor, W., "[20] Processing of X-ray Diffraction Data Collected in Oscillation Mode," Methods in Enzymology, vol. 276, pp. 307-326 (1997).
Pancera, M., et al., "Crystal Structure of PG16 and Chimeric Dissection with Somatically Related PG9: Structure-Function Analysis of Two Quaternary-Specific Antibodies that Effectively Neutralize HIV-1," Journal of Virology, vol. 84, No. 16, pp. 8098-8110 (Aug. 2010).
Paradis, E., et al., "APE: Analyses of Phylogenetics and Evolution in R language," Bioinformatics, vol. 20, No. 2, pp. 289-290 (2004).
Perreau, M., et al., "DNA/NYVAC Vaccine Regimen Induces HIV-Specific CD4 and CD8 T-Cell Responses in Intestinal Mucosa," Journal of Virology, vol. 85, No. 19, pp. 9854-9862 (Oct. 2011).
Pissani, F., et al., "Motif-Optimized Subtype A HIV Envelope-based DNA Vaccines Rapidly Elicit Neutralizing Antibodies When Delivered Sequentially," Vaccine, vol. 30, No. 37, pp. 5519-5526, Author Manuscript—17 pages (Aug. 10, 2012).
Rerks-Ngarm, S., et al., "Vaccination with ALVAC and AIDSVAX to Prevent HIV-1 Infection in Thailand," NEJM, vol. 361, No. 23, pp. 2209-2220 (Dec. 3, 2009).
Richman, D. D. et al., "Rapid evolution of the neutralizing antibody response to HIV type 1 infection," Proc. Natl. Acad. Sci. USA, vol. 100, No. 7, pp. 4144-4149 (Apr. 1, 2003).
Santra, S., et al., "Mosaic Vaccines Elicit CD8+ T lymphocyte Responses in Monkeys that Confer Enhanced Immune Coverage of Diverse HIV Strains," Nature Med., vol. 16, No. 3, pp. 324-328, Author Manuscript—13 pages (Mar. 2010).
Sattentau, Q. J. and McMichael, A. J., "New templates for HIV-1 antibody-based vaccine design," F1000 Biol. Rep., vol. 2, No. 60, pp. 1-6 (Aug. 9, 2010).
Scheid, J. F., et al., "Broad diversity of neutralizing antibodies isolated from memory B cells in HIV-infected individuals," Nature, vol. 458, pp. 636-640 (Apr. 2, 2009).
Scheid, J. F., et al., "Sequence and Structural Convergence of Broad and Potent HIV Antibodies That Mimic CD4 Binding," Science, vol. 333, No. 6049, pp. 1633-1637, Author Manuscript—11 pages (Sep. 16, 2011).
Scheid, J., et al., "A method for identification of HIV gp140 binding memory B cells in human blood," J. Immunol. Methods, vol. 343, No. 2, pp. 65-67, Author Manuscript—7 pages (Apr. 15, 2009).
Seaman, M. S., et al., "Tiered Categorization of a Diverse Panel of HIV-1 Env Pseudoviruses for Assessment of Neutralizing Antibodies," J. Virol., vol. 84, No. 3, pp. 1439-1452 (Feb. 2010).
Shingai, M., et al., "Most rhesus macaques infected with the CCR5-tropic SHIVAD8 generate cross-reactive antibodies that neutralize multiple HIV-1 strains," Proc. Natl. Acad. Sci. USA, vol. 109, No. 48, pp. 19769-19774 (Nov. 27, 2012).
Stamatatos, L., "HIV vaccine design: the neutralizing antibody conundrum," Curr. Opin. Immunol., vol. 24, pp. 316-323 (2012).
Tomaras, G. D., et al., "Initial B-Cell Responses to Transmitted Human Immunodeficiency Virus Type 1: Virion-Binding Immunoglobulin M (IgM) and IgG Antibodies Followed by Plasma Anti-gp41 Antibodies with Ineffective Control of Initial Viremia," J. Virol., vol. 82, No. 24, pp. 12449-12463 (Dec. 2008).
Tomaras, G. D., et al., "Polyclonal B Cell Responses to Conserved Neutralization Epitopes in a Subset of HIV-1-Infected Individuals," Journal of Virology, vol. 85, No. 21, pp. 11502-11519 (Nov. 2011).
U.S. Appl. No. 61/708,503, filed Oct. 1, 2012 (41 pages).
U.S. Appl. No. 61/806,717, filed Mar. 29, 2013 (71 pages).
Walker, L. M., et al., "Broad and Potent Neutralizing Antibodies from an African Donor Reveal a New HIV-1 Vaccine Target," Science, vol. 326, No. 5950, pp. 285-289, Author Manuscript—10 pages (Oct. 9, 2009).
Walker, L. M., et al., "Broad neutralization coverage of HIV by multiple highly potent antibodies," Nature, vol. 477, No. 7365, pp. 466-470, Author Manuscript—10 pages (Sep. 22, 2011).
Wardemann, H., et al., "Predominant Autoantibody Production by Early Human B Cell Precursors," Science, vol. 301, pp. 1374-1377 (Sep. 5, 2003).
Wei, X., et al., "Antibody neutralization and escape by HIV-1," Nature, vol. 422, pp. 307-312, 7 pages (Mar. 20, 2003).
Wu, X., et al., "Focused Evolution of HIV-1 Neutralizing Antibodies Revealed by Structures and Deep Sequencing," Science, vol. 333, No. 6049, pp. 1593-1602, Author Manuscript—17 pages (Sep. 16, 2011).
Wu, X., et al., "Rational Design of Envelope Identifies Broadly Neutralizing Human Monoclonal Antibodies to HIV-1," Science, vol. 329, pp. 856-861 (Aug. 13, 2010).
Xiao, X., et al., "Germline-like predecessors of broadly neutralizing antibodies lack measurable binding to HIV-1 envelope glycoproteins: implications for evasion of immune responses and design of vaccine immunogens," Biochem. Biophys. Res. Commun., vol. 390, No. 3, pp. 404-409, Author Manuscript—14 pages (Dec. 18, 2009).
Yu, J-S, et al., "Generation of Mucosal Anti-Human Immunodeficiency Virus Type 1 T-Cell Responses by Recombinant Mycobacterium smegmatis," Clinical and Vaccine Immunology, vol. 13, No. 11, pp. 1204-1211 (Nov. 2006).
Yu, J.-S., et al., "Recombinant Mycobacterium bovis, Bacillus Calmette-Guérin Elicits Human Immunodeficiency Virus Type 1 Envelope-Specific T Lymphocytes at Mucosal Sites," Clinical and Vaccine Immunology, vol. 14, No. 7, pp. 886-893 (Jul. 2007).
Zhou, T., et al., "Structural Basis for Broad and Potent Neutralization of HIV-1 by Antibody VRC01," Science, vol. 329, No. 5993, pp. 811-817, Author Manuscript—19 pages (Aug. 13, 2010).

\* cited by examiner

Hamming distance frequency distributions of sequences at (a) week 4 and (b) week 14. A model of the best fit Poisson distribution is shown as a red line. Analysis of the sequence diversity in the first available sample (a) from subject CH505 using the Poisson Fitter tool (ref below) indicates that the sequences were a consistent with a star phylogeny and that the mutations were accumulating according to a Poisson distribution (goodness of fit p = 0.11). This is consistent with a single founder virus establishing the infection, with random accumulation of mutations prior to selection. The lambda parameter was 1.325, and assuming the mutation rate of 2.16 10$^{-05}$, the estimated time from the most recent common ancestor was 22 days (95% CI, 18-27). Given that the outer bound of this confidence interval is 27 days, it is highly like this sample was taken within 4 weeks of infection, thus we are calling this sampling time "week 4" as a conservative estimate. This timing estimate is further supported by Feibig staging at time of enrollment. By week 14 (b), the tree was no longer consistent with a star phylogeny or a Poisson distribution (p << 10$^{-10}$), indicating selection was well underway. Of note, although the mutation data at week 4 (a) is statistically consistent with a Poisson distribution, the observed number of pairwise sequence identities was somewhat reduced relative to expectation, and the observed number of Hamming distances of 1 and 2 are slightly more than expected. This is of interest as this shift is the a result of a single mutation in loop D, in a CH103 contact residue (N279K) — so although the deviation from the Poisson was not significant, given its location it is possible that the site is a very early indicator of selection.

*Reference: Giorgi EE, Funkhouser B, Athreya G, Perelson AS, Korber BT, Bhattacharya T. Estimating time since infection in early homogeneous HIV-1 samples using a Poisson model. BMC Bioinformatics 2010 Oct 25;11:532. PMID: 20973976*
*http://www.hiv.lanl.gov/content/sequence/POISSON_FITTER/poisson_fitter.html*

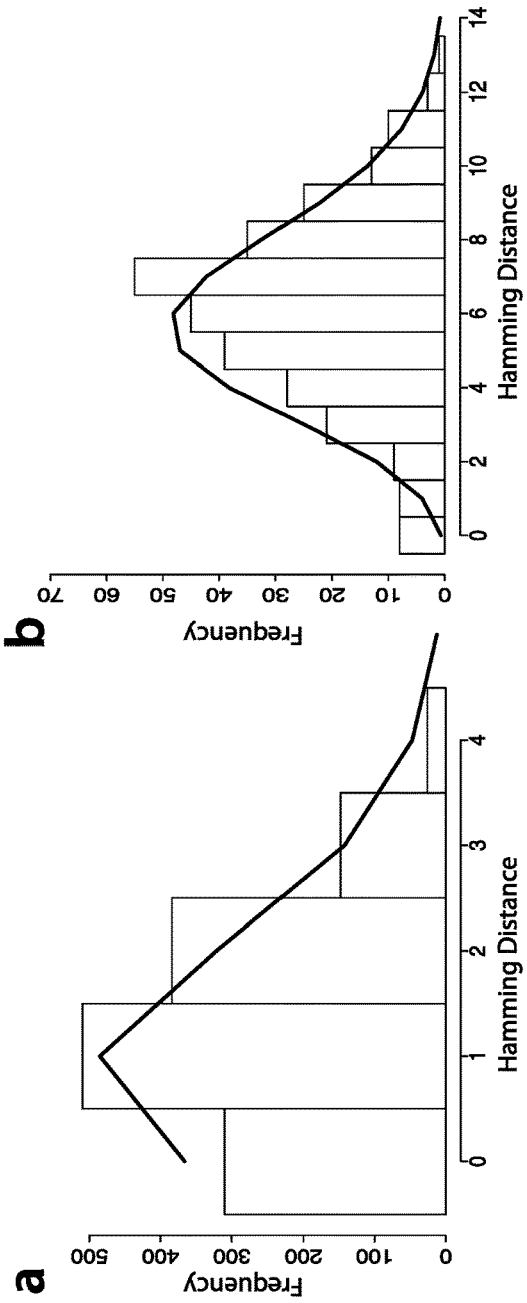

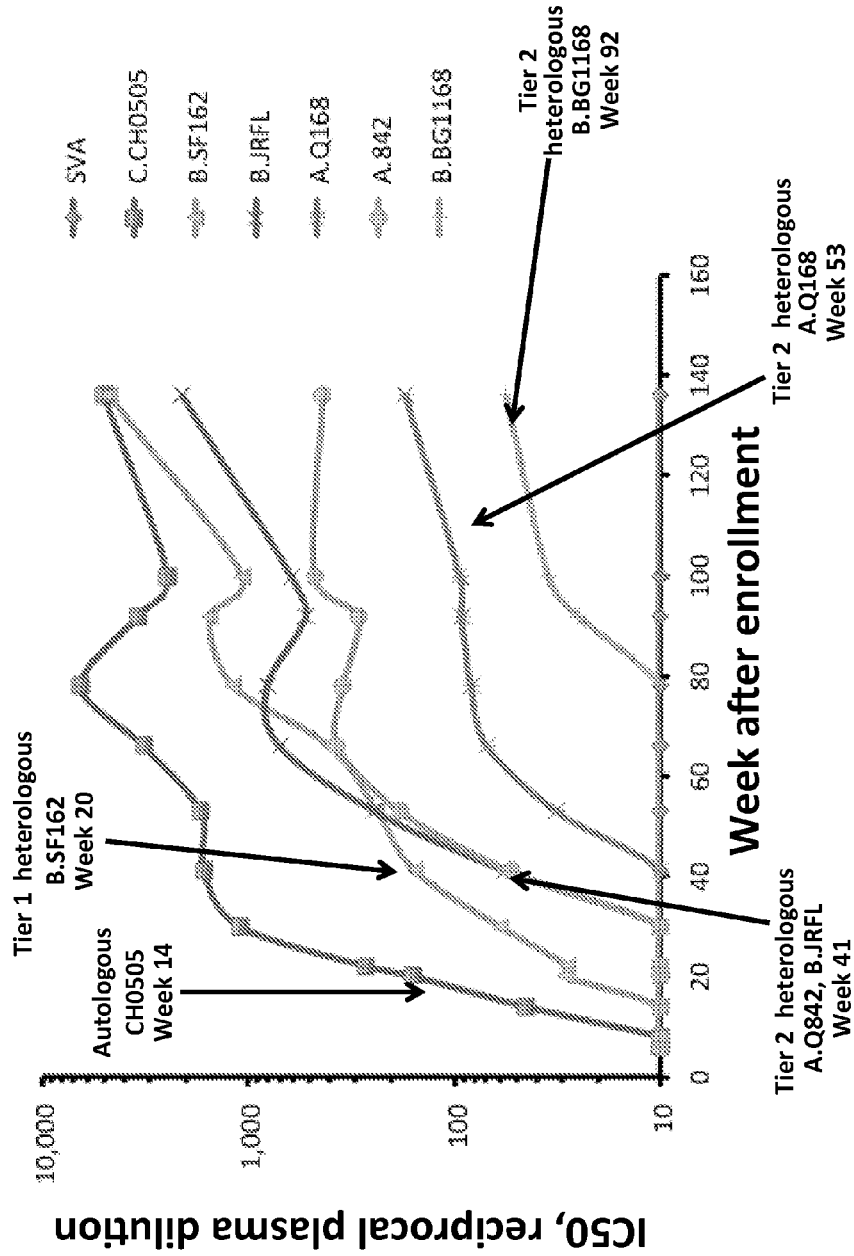

FIG. 8

Binding of plasma antibodies of CH505 patient over time to autologous transmitted/founder (T/F) and heterologous HIV-1 Env proteins. Plasma samples were longitudinally collected from HIV-1 patient CH505 starting from time of infection (in x axis) and tested for neutralization activity against the autologous transmitted/founder (T/F) virus and heterologous HIV-1 Env pseudoviruses including subtype B (B) SF162, JRFL and BG1168) and subtype A in TZM-bl cell-based neutralization assays. Results were expressed as IC50 (reciprocal plasma dilution) (in y axis).

FIG. 9

Reactivity of antibodies in CH103 clonal lineage to HIV-1 Env resurfaced core3 (RSC3) and RSC3 mutant. Antibodies in CH103 clonal lineage were tested in dose range from 100µg to 0.0005µg/ml for binding to (a) HIV-1 Env RSC) and (b) RSC3 with P363N and Δ371I mutations in ELISA. Results are expressed as EC50 (µg/ml) and are indicated next to the individual antibodies. NB = no detectable binding.

a

- I1 — CH106 0.26
- I1 0.33 — CH103 4.80
- I2 0.40 — CH104 0.32
- CH105 0.48
- I3 1.0
- 1AH92U >100
- I4 NB
- 1AZCETI5 NB
- I7 NB — 1A102RI6 NB
- I8 NB
- UCA NB b

- I1 NB — CH106 NB
- I1 NB — CH103 NB
- I2 NB — CH104 NB
- CH105 NB
- I3 NB
- 1AH92U NB
- I4 NB
- 1AZCETI5 NB
- I7 NB — 1A102RI6 NB
- I8 NB
- UCA NB

FIG. 10

**SDS-PAGE analysis of recombinant HIV-1 Env gp140 and gp120 proteins*. HIV-1 Env gp120 and gp140 proteins were analyzed on SDS-PAG under reducing condition (a) and gp140 proteins were analyzed on blue negative PAGE for (b). Individual HIV-1 Env proteins are identified on the tope of gels. a, The HIV-1 gp120 and gp140 used in the study had no degradation under reducing condition in SDS-PAGE. b,** Most heterologous HIV-1 Env gp140 Envs and all autologous CH505 gp140 Envs migrated predominantly as trimers and also contain dimer and monomer forms.

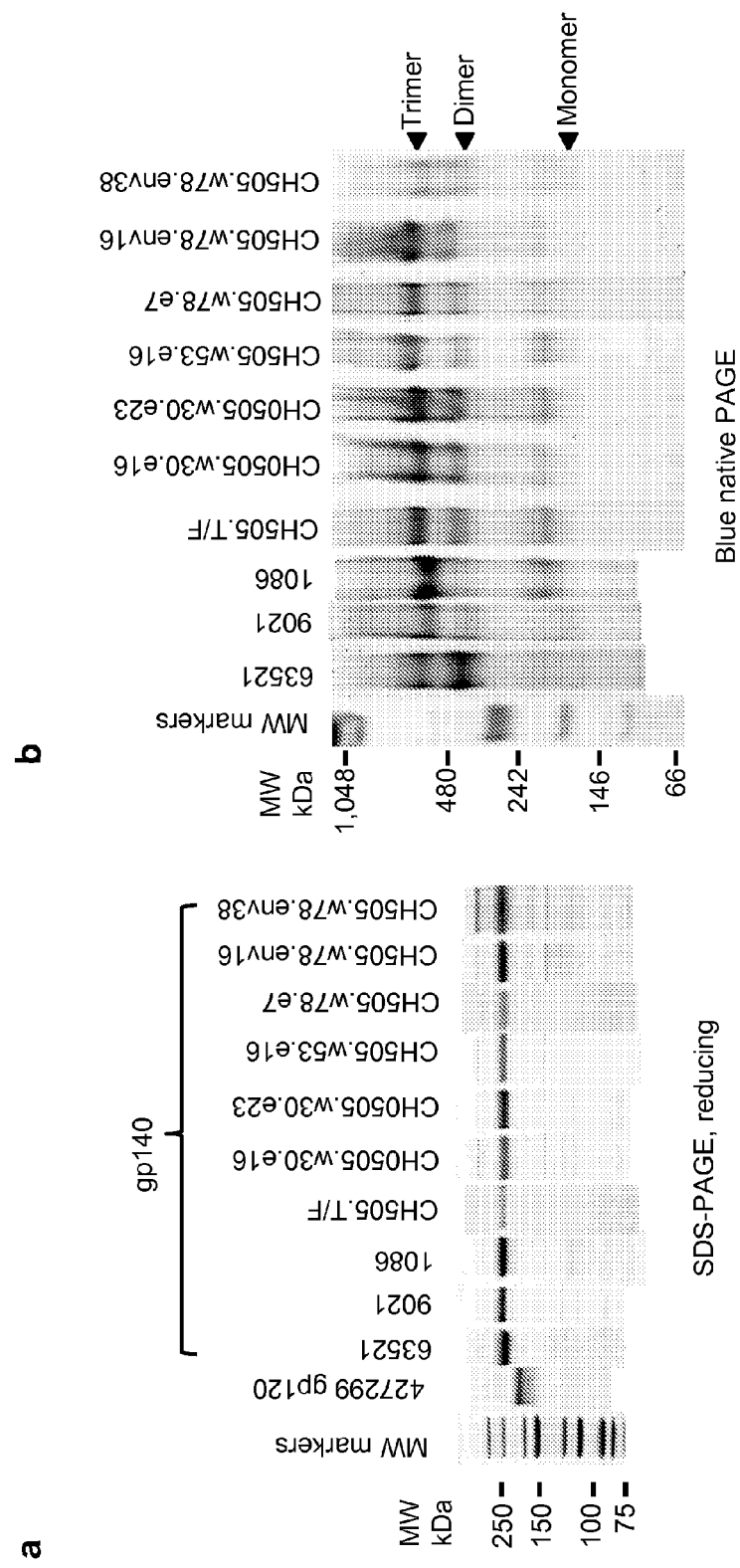

FIG. 11

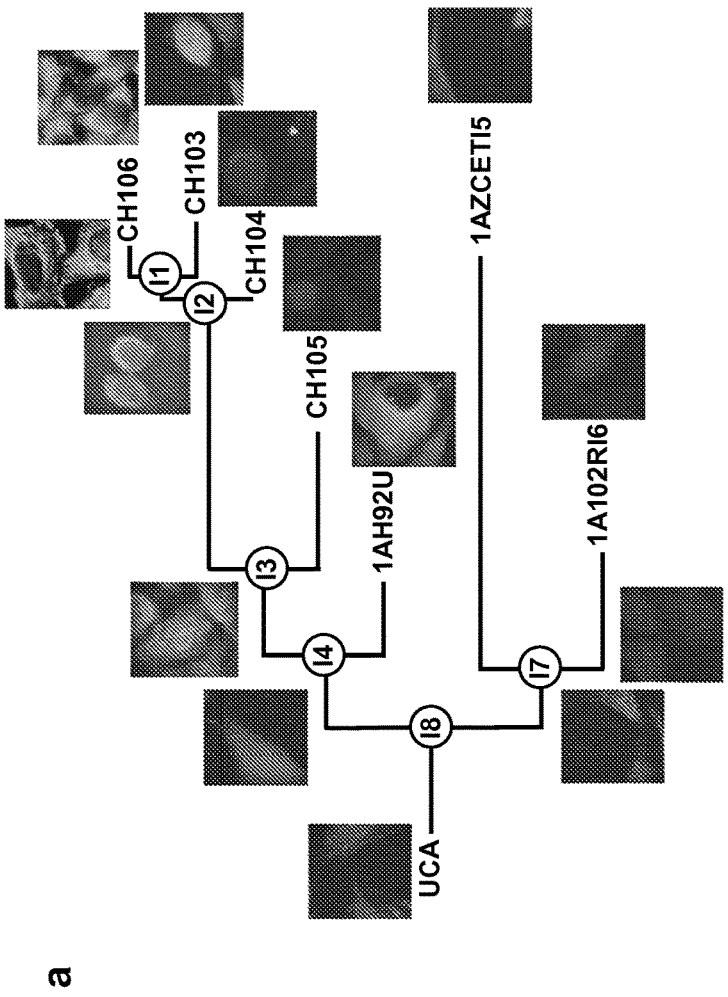

Polyreactivity analysis of CH103 clonal lineage antibodies by HEp-2 staining, ANA assays and protein array microchip analysis. Reactivity of antibodies in CH103 clonal lineage was assayed by indirect immunofluorescence staining (a) and by ANA assays (b). Pictures at magnification x 200 of immunofluorescence staining for individual antibodies are presented next to the antibody ID. Results of the reactivity of individual antibodies with panel of autoantigens assayed by ANA is indicated (b). The intermediate antibody (I1) and CH106 were identified as reactive with HEp-2 cells and then selected for further testing for reactivity with human host cellular antigens (c and d) using Invitrogen ProtoArrays™. It was found that I1 (c) and CH106 ((d) exhibit specific autoreactivity and robust polyreactivity. Bound antibody was determined by immunofluorescence and relative fluorescence intensities for 9,400 recombinant human proteins in the 151K array (y-axis) is plotted against (x-axis) the homologous intensities in IA1 (c) and CH106 (d) arrays. All proteins are printed in duplicate on each array and each data point represents one fluorescence measurement. The diagonals in each graph represent equal fluorescence intensities (equivalent binding) by the I1, CH106 and 151K control Ab. Self-antigens bound by the I1 and CH106 are identified by high fluorescence intensity versus 151K and are indicated by circles. Polyreactivity is indicated by significant and general skewing from the diagonal. Autoantigens identified: BHMT2 (betaine-homocysteine methyltransferase 2) [IA1 and CH106]; CENP-R (centromere protein R) [151K]; eEF-2K (eukaryotic elongation factor-2 kinase); UBE3A (ubiquitin-protein ligase E3A) [IA1 and CH106]; TGM2 (transglutaminase 2) [CH106]; NFKBIA (nuclear factor of kappa light polypeptide gene enhancer in B-cells inhibitor, alpha); FAM184A (family with sequence similarity 184, member A) [I1].

FIG. 11

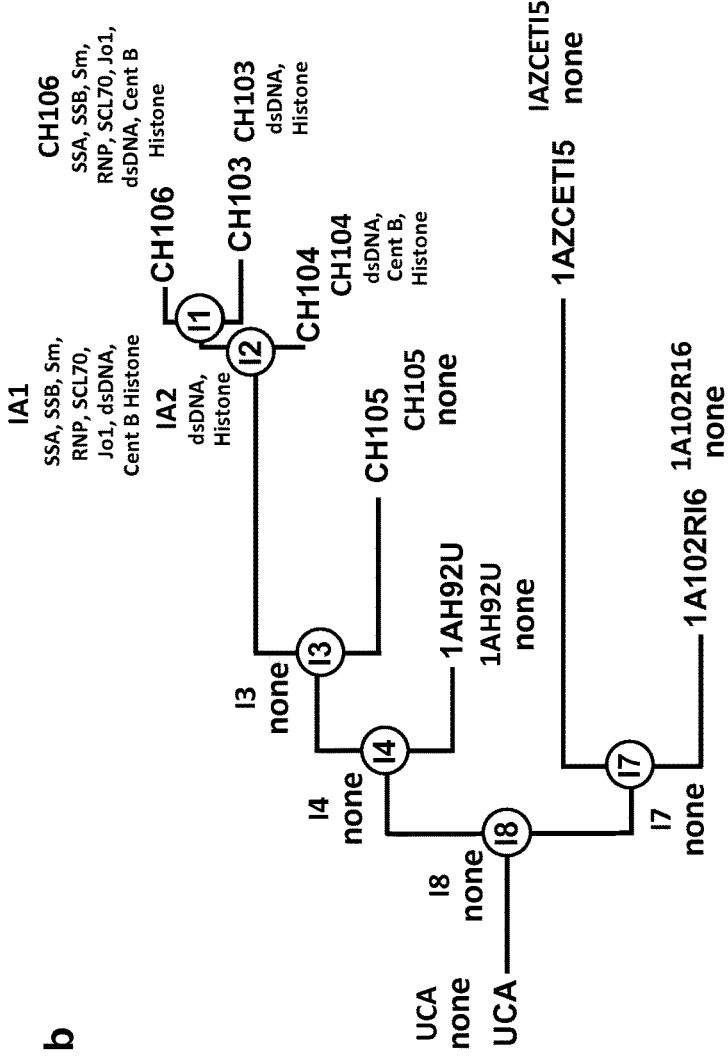

Polyreactivity analysis of CH103 clonal lineage antibodies by HEp-2 staining, ANA assays and protein array microchip analysis. Reactivity of antibodies in CH103 clonal lineage was assayed by indirect immunofluorescence staining (a) and by ANA assays (b). Pictures at magnification x 200 of immunofluorescence staining for individual antibodies are presented next to the antibody ID. Results of the reactivity of individual antibodies with panel of autoantigens assayed by ANA is indicated (b). The intermediate antibody (I1) and CH106 were identified as reactive with HEp-2 cells and then selected for further testing for reactivity with human host cellular antigens (c and d) using Invitrogen ProtoArrays™. It was found that I1 (c) and CH106 ((d) exhibit specific autoreactivity and robust polyreactivity. Bound antibody was determined by immunofluorescence and relative fluorescence intensities for 9,400 recombinant human proteins in the 151K array (y-axis) is plotted against (x-axis) the homologous intensities in IA1 (c) and CH106 (d) arrays. All proteins are printed in duplicate on each array and each data point represents one fluorescence measurement. The diagonals in each graph represent equal fluorescence intensities (equivalent binding) by the I1, CH106 and 151K control Ab. Self-antigens bound by the I1 and CH106 are identified by high fluorescence intensity versus 151K and are indicated by circles. Polyreactivity is indicated by significant and general skewing from the diagonal. Autoantigens identified: BHMT2 (betaine-homocysteine methyltransferase 2); CENP-R (centromere protein R) [151K]; eEF-2K (eukaryotic elongation factor-2 kinase); UBE3A (ubiquitin-protein ligase E3A) [IA1 and CH106]; TGM2 (transglutaminase 2) [CH106]; NFKBIA (nuclear factor of kappa light polypeptide gene enhancer in B-cells inhibitor, alpha); FAM184A (family with sequence similarity 184, member A) [I1].

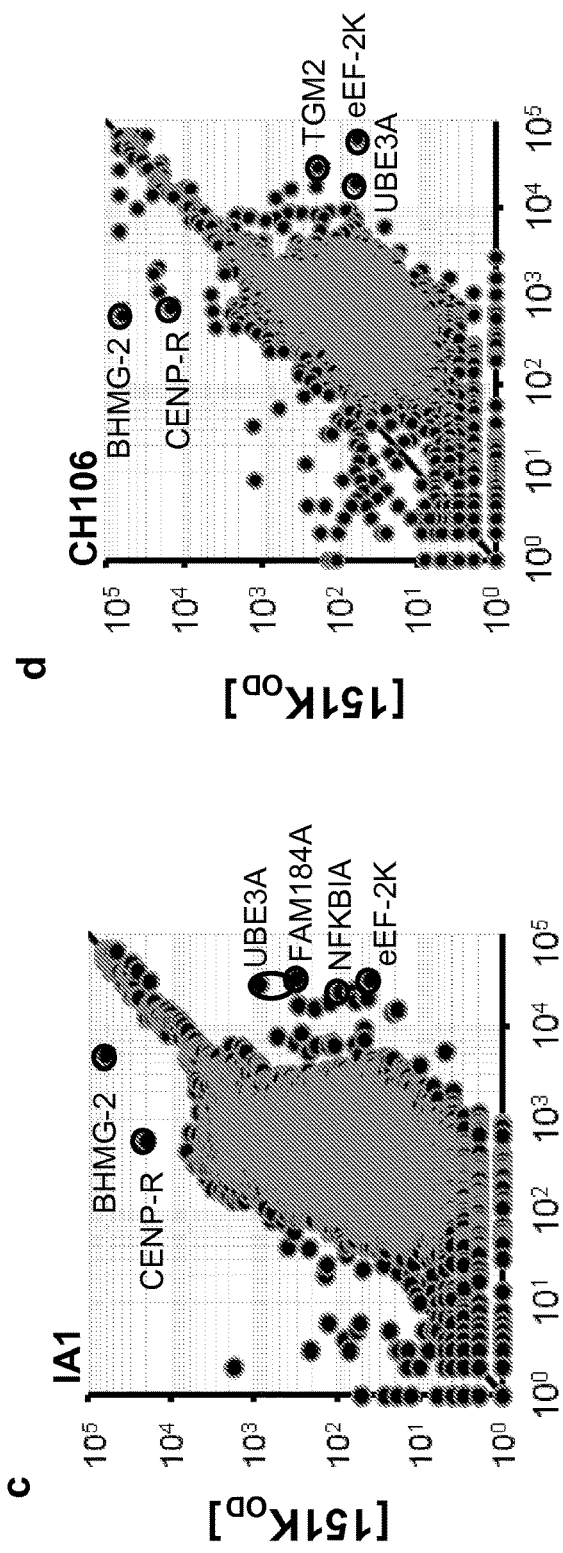

Polyreactivity analysis of CH103 clonal lineage antibodies by HEp-2 staining, ANA assays and protein array microchip analysis. Reactivity of antibodies in CH103 clonal lineage was assayed by indirect immunofluorescence staining (a) and by ANA assays (b). Pictures at magnification x 200 of immunofluorescence staining for individual antibodies are presented next to the antibody ID. Results of the reactivity of individual antibodies with panel of autoantigens assayed by ANA is indicated (b). The intermediate antibody (I1) and CH106 were identified as reactive with HEp-2 cells and then selected for further testing for reactivity with human host cellular antigens (c and d) using Invitrogen ProtoArrays™. It was found that I1 (c) and CH106 ((d) exhibit specific autoreactivity and robust polyreactivity. Bound antibody was determined by immunofluorescence and relative fluorescence intensities for 9,400 recombinant human proteins in the 151K array (y-axis) is plotted against (x-axis) the homologous intensities in IA1 (c) and CH106 (d) arrays. All proteins are printed in duplicate on each array and each data point represents one fluorescence measurement. The diagonals in each graph represent equal fluorescence intensities (equivalent binding) by the I1, CH106 and 151K control Ab. Self-antigens bound by the I1 and CH106 are identified by high fluorescence intensity versus 151K and are indicated by circles. Polyreactivity is indicated by significant and general skewing from the diagonal. Autoantigens identified: BHMT2 (betaine-homocysteine methyltransferase 2); CENP-R (centromere protein R) [151K]; eEF-2K (eukaryotic elongation factor-2 kinase); UBE3A (ubiquitin-protein ligase E3A) [IA1 and CH106]; TGM2 (transglutaminase 2) [CH106]; NFKBIA (nuclear factor of kappa light polypeptide gene enhancer in B-cells inhibitor, alpha); FAM184A (family with sequence similarity 184, member A) [I1].

FIG. 12

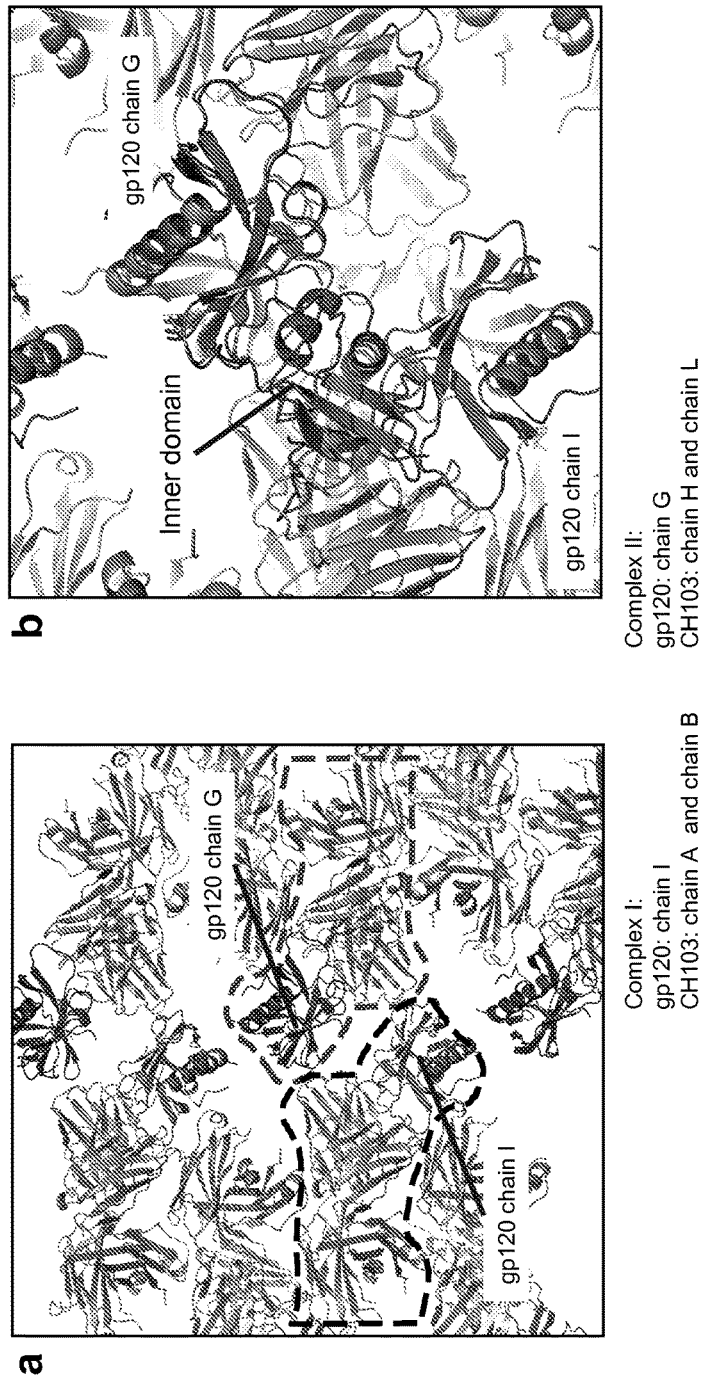

Crystal packing of the CH103-gp120 complex in P21 space group. a, A view of the crystal lattice. The two complexes in each asymmetric unit are marked with red and blue dashed lines and are shown in cartoon diagrams with gp120 in red and salmon, CH103 heavy chain in green and palegreen, and CH103 light chain in light blue and cyan. b, A close-up view of the lattice between two neighboring complexes. When extended core gp120 of clade C ZM176.66 from the VRC01 complex is superposed with its ordered corresponding portions in the CH103 complex, the inner domain shown in magenta clashes with the neighboring complex, indicating inner domain of gp120 is not present in the CH103-gp120 crystal due to proteolytic degradation during crystal growth.

FIG. 13

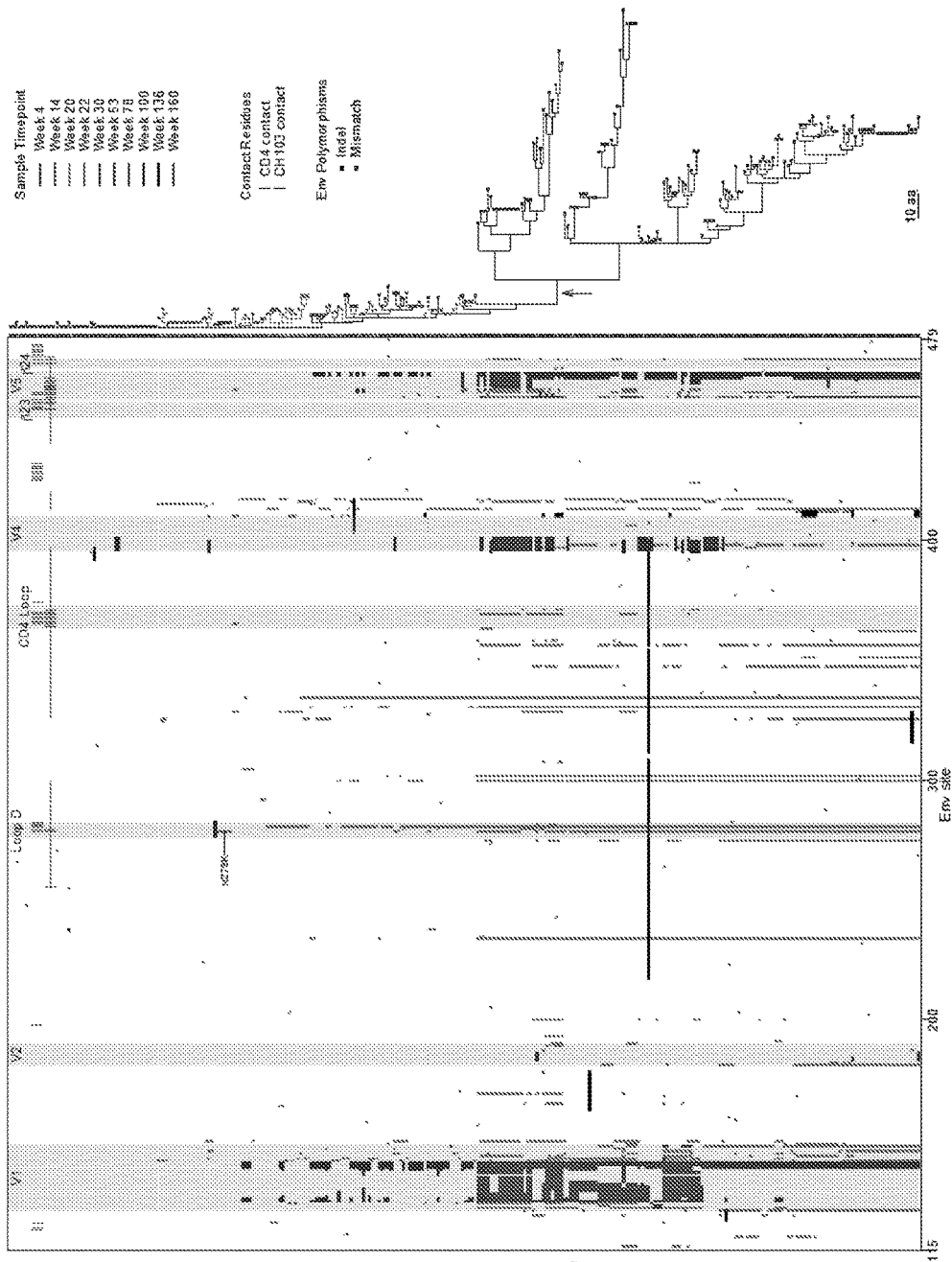

Pixel map and phylogenetic tree of HIV evolution over time in CH505. The pixel tool (http://www.hiv.lanl.gov/content/sequence/pixel/pixel.html) was used to illustrate the amino changes in the V1 to V5 region of the envelope; we focused on this region as it most critical CD4bs antibody susceptibility, and includes of all known CD4 binding contacts, which are indicated as black tic marks along the top of the figure. Blue tic marks indicated CH103 contact residues, and the horizontal blue line indicates that part of gp120 that was used for the CH103 crystal structure (although the contact surface is mostly there, still quite a bit is missing that is important for CD4 and VRC01, which is why we use CD4 contacts to help define bits that may be important for CH103 binding in those missing regions). Each row is a sequences, and they are ordered according to the phylogeny. Red bits indicate amino acid change relative to the TF virus, and black bits indicate either an insertion or deletion. The phylogenetic tree on the right was made with PhyML v2 [1] and the JTT substitution model [2] from the translated Env sequences. The tree was commfigured as a ladder and the T/F virus was reconstructed from the first time point sequences obtained at week 4 after transmission. Colors indicated the estimated number of weeks from infection. The tree was rendered with APE v3.0-6 [3] and both used R v2.15.1 [4]. The arrow indicates the week 30-53 selective bottleneck.

1. Guindon S, Gascuel O. 2003. A simple, fast and accurate algorithm to estimate large phylogenies by maximum likelihood. Syst. Biol. 52:696–704.
2. Jones DT, Taylor WR, Thornton JM. 1992. The rapid generation of mutation data matrices from protein sequences. Comput Applic Biosci 8: 275–282.
3. Paradis E, Claude J, Strimmer K. 2004. APE: analyses of phylogenetics and evolution in R language. Bioinformatics 20: 289–290.
4. R Core Team. 2012. R: A language and environment for statistical computing. R Foundation for Statistical Computing, Vienna, Austria. ISBN 3-900051-07-0, URL http://www.R-project.org/.

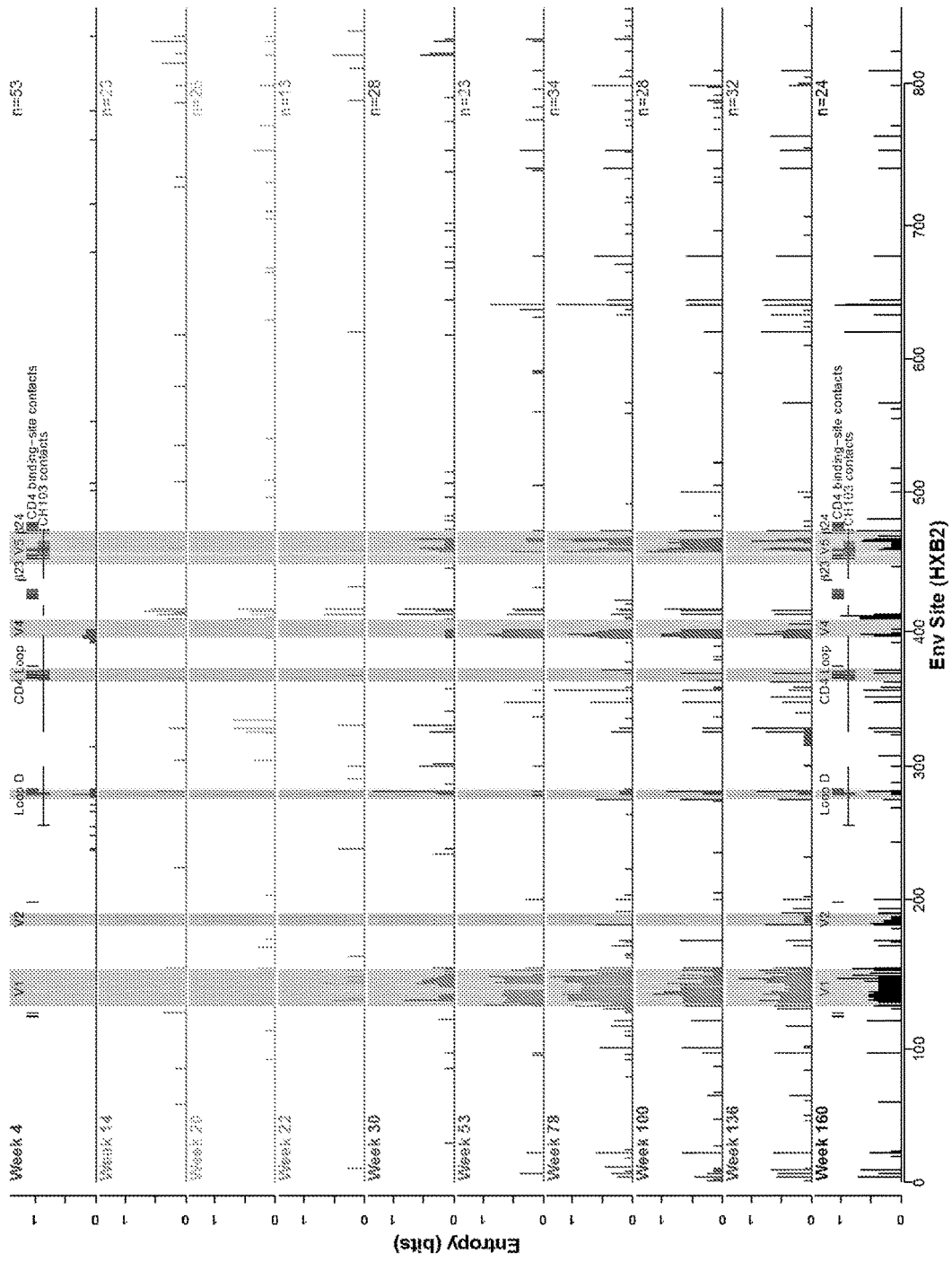

FIG. 14

Entropy map illustrating the per site diversity within each time point sampled in CH505. Full gp160 is shown, and CD4 and CH103 contact residues are highlighted. This figure shows the Shannon entropy of each position in the alignment, where the observed frequency of all in a position characters is considered, and a gap is treated as a character (Korber J Virol. 1994;68(11):7467-81). This provides a map of regional within-time point diversity spanning Env, and illustrates where mutations are concentrated and the relative diversity of key regions over time.

FIG. 15

A comparison of the speed of viral sequence evolution in CH505 in regions relevant to the CH103 epitope to other subjects. a, The distribution of sequence distances expressed as the percentage of amino acids that are different between two sequences, resulting from in a pair-wise comparison of all sequences sampled in a given time point. These are all homogeneous infection cases, so in acute infection there is very little mutation in the CH103 relevant regions, or elsewhere in the virus (left hand panels). By 24 weeks after enrollment (week 30 from infection in CH505, labeled month 6 here as it is approximate), extensive mutations have begun to accrue, focused in CH103 relevant regions (top middle panel), but not in other regions of Env (bottom middle panel). CH103 has the highest ranked diversity among 15 subject sampled in this time frame (p= 0.067), indicating a focused selective pressure began unusually early in this subject. By 1 year (month 12 indicates samples taken between 10-14 months from enrollment), this region has begun to evolve in many individuals, possibly due to autologous NAb responses that come up later in infection.

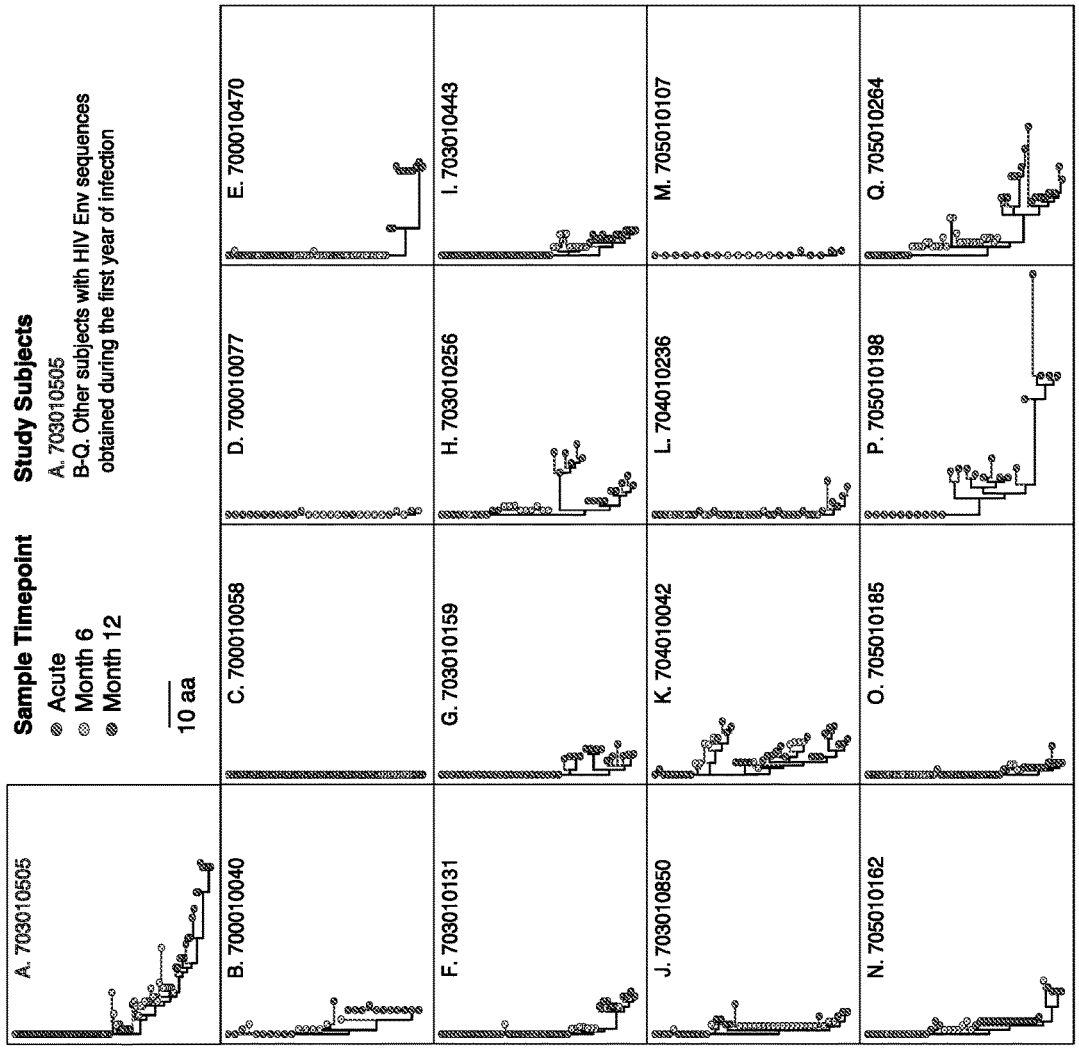

FIG. 15

A comparison of the speed of viral sequence evolution in CH505 in regions relevant to the CH103 epitope to other subjects. b, Phylogenetic trees based on CH103 relevant regions. In this view, the extensive evolution away from the T/F virus by month 6, shown in gold, is particularly striking. The distance between sequences sampled in CH505 at month 6 and the T/F ancestral state were much greater than the sequences in the second most variable individual 704010042 (Wilcoxon rank sum, p = 0.0003: CH505, median = 0.064, range = 0.019 – 0.13, N = 25, and 704010042, median = 0.027, range = 0.009 – 0.056, N = 26).

Co-evolution of virus and antibody - interplay between maturation of antibody CH103 and sequence variability epitope in gp120. The sequence variability (within sample) at each time point is mapped on a gp120 structure that tracks the viral evolution over time from 14 weeks thru 100 weeks post-transmission. Entrop

FIG. 17A

>703010505.TF
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPEKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLPIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.31
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPEKNITFQPSSGGDLEITTHSFNCGGEFFYCNTSSLFNRTYMANST
ETNSTRTITIHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQ
QHMLKLTVWGIKQLQARVLALERYLKDQQLLGMWGCSGKLICTTNVYWNSSWSNKTYGDIWDNMTWMQWEREISNYT
EIIYELLEESQNQQEKNEQDLLALDRWNSLWNWFNITNWLWYIKIFIMIVGGLIGLRIIFAVLSLVNRVRQGYSPLS
LQTLIPSPRGPDRPGGIEEEGGEQDRNRSTRLVSGFLALVWDDLRSLCLFIYHRLRDFILIAARAGELLGRSSLKGL
RRGWEALKYLGSLVQYWGLELKRSAISLLDTLAIAVGEGTDRILEFVLGICRAIRNIPTRIRQGFETALL*
>703010505.w4.27
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPEKNITFQPSSGGDLEITTHSFNCGGEFFYCNTSSLFNRTYMANST
ETNSTRTITIHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQ
QHMLKLTVWGIKQLQARVLALERYLKDQQLLGMWGCSGKLICTTNVYWNSSWSNKTYGDIWDNMTWMQWEREISNYT
EIIYELLEESQNQQEKNEQDLLALDRWNSLWNWFNITNWLWYIKIFIMIVGGLIGLRIIFAVLSLVNRVRQGYSPLS
LQTLIPSPRGPDRPGGIEEEGGEQDRNRSTRLVSGFLALVWDDLRSLCLFIYHRLRDFILIAARAGELLGRSSLKGL
RRGWEALKYLGSLVQYWGLELKRSAISLLDTLAIAVGEGTDRILEFVLGICRAIRNIPTRIRQGFETALL*
>703010505.w4.03
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPEKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLGYIKIFIMIVGGLIGLFIIFAVLSLVNRVRQ
GYSPLSLQTLIPSPRGPDRPGGIEEEGGEQDRNRSTRLVSGFLALVWDDLRSLCLPIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.51
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLFEGEIIIRSENITNNVKTIIVHLNESVKIECTRPNNKTRTSIRIGPGQAFYATGQV
IGDIREAYCNINESKWNETLQRVSKKLKEYFPEKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLPIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.19
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPG*AFYATGQV
IGDIREAYCNINESKWNETLQRVSKKLKEYFPEKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ

FIG. 17A cont'd

```
GYSPLSLQTLIPSPRGPDRPGGIEEEGGEQDRNRSTRLVSGFLALVWDDLRSLCLFTYHRLRDFILIAAPAGELLGR
SSLKGLRRGWEALKYLGSLVQYWGLELKRSAISLLDTLAIAVGEGTDRILEFVLGICRAIRNIPTRIRQGFETALL*
>703010505.w4.46
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQEMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.44
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVPLGFLGAAGSTMGAASITLTVQARQLLSGIVQQQSNLL
KAIEAQQEMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.43
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVPLGFLGAAGSTMGAASITLTVQARQLLSGIVQQQSNLL
KAIEAQQEMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.21
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQEMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFTYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.49
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQEMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.23
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
```

FIG. 17A cont'd

```
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.04
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAAPAGELLGR
SSLKGLRRGWEALKYLGSLVQYWGLELKRSAISLLDTLAIAVGEGTDRILEFVLGICRAIRNIPTRIRQGFETALL*
>703010505.w4.28
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.48
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.52
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAAPAGELLGR
SSLKGLRRGWEALKYLGSLVQYWGLELKRSAISLLDTLAIAVGEGTDRILEFVLGICRAIRNIPTRIRQGFETALL*
>703010505.w4.33
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.18
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
```

FIG. 17A cont'd

```
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVPLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.20
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVPLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.34
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVPLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.55
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVPLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.45
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVPLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.25
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVPLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.02
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
```

FIG. 17A cont'd

```
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.24
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.42
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.59
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.39
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.22
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.05
```

FIG. 17A cont'd

>703010505.w4.33
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.40
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.16
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLLLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.14
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLRR
SSLKGLRRGWEALKYLGSLVQYWGLELKRSAISLLDTLAIAVGEGTDRILEFVLGICRAIRNIPTRIRQGFETALL*
>703010505.w4.41
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ

FIG. 17A cont'd

```
GYSPLSLQTLIPSPRGPDRPGGIEEEGGEQDRNRSTRLVSGFLALVWDDLRSLCLFIYHRLRDFILIAAPAGELLGR
SSLKGLRRGWEALKYLGSLVQYWGLELKRSAISLLDTLAIAVGEGTDRILEFVLGICRAIRNIPTRIRQGFETALL*
>703010505.w4.11
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.09
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.37
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCAHGIKPVVSTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.12
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.50
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.13
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTHMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
```

FIG. 17A cont'd

```
XAIEAQQEMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.56
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFTYHRLRDFILIAARAGELLGR
SSLKGLRRGWEALKYLGSLVQYWGLELKRSAISLLDTLAIAVGEGTDRILEFVLEICRAIRNIPTRIRQGFETALL*
>703010505.w4.26
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNPTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNVRERVVEREKRAVGMGAVFLGFLGAAGSTMGAASITLTVQARQLLSGIVQQQSNLL
KAIEAQQEMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.29
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTETITIHCRIKQIINMWQEVGRAMYAPPIAGNITCISNITGLLLTRDGGKNNTETFRPGGGNMKDNW
RSELYKYKVVEVKPLGVAPTNARRRVVGREKRAVGMGAVFLGFLGAAGSTMGAASITLTVQARQLLSGIVQQQSNLL
KAIEAQQEMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.07
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQEMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFTYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.36
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQEMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFTYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.54
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
```

FIG. 17A cont'd

```
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLIEFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.10
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.47
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.61
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.15
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w4.06
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGT#CNNVSTV
QCTHGIKPVISTQLLLNGSLAEGEIIRSENITNNVKTIIVHLNESVKIECTRPNNKTRTSIRIGPGQAFYATGQVI
GDIREAYCNINESKWNETLQRVSKKLKEYFPHKNITFQPSSGGDLEITTHSFNCGGEFFYCNTSSLFNRTYMANSTD
MANSTETNSTRTITIHCRIKQIINMWQEVGRAMYAPPIAGNITCISNITGLLLTRDGGKNNTETFRPGGGNMKDNWR
SELYKYXVVEVKPLGVAPTNARRRVVEREKRAVGMGAVFLGFLGAAGSITLTVQARQLLSGIVQQQSNLLK
AIEAQQHMLKLTVWGIKQLQARVLALERYLKDQQLLGMWGCSGKLICTTNVYWNSSWSNKTYGDIWDNMTWMQWERE
ISNYTEIIYELLEESQNQQEKNEQDLLALDRWNSLWNWFNITNWLWYIKIFIMIVGGLIGLRIIFAVLSLVNRVRQG
YSPLSLQTLIPSPRGPDRPGGIEEEGGEQDRNRSTRLVSGFLALVWDDLRSLYLFIYHRLRDFILIAARAGELLGRS
SLKGLRRGWEALKYLGSLVQYWGLELKRSAISLLDTLAIAVGEGTDRILEFVLGICRAIRNIPTRIRQGFETALL*
>703010505.w4.08
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
```

FIG. 17A cont'd

VQCTHGIKPVVSTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNSTDMANST
ETNSTRTITIHCRIKQIINMWQEVGRAMYAPPIAGNITCISNITGLLLTRDGGKNNTETFRPGGGNMKDNWRSELYK
YKVVEVKPLGVAPTNAERRVVEREKRAVGMGAVPLGFLGAAGSTMGAASITLTVQARQLLSGIVQQQSNLLKAIEAQ
QHMLKLTVWGIKQLQARVLALERYLKDQQLLGMWGCSGKLICTTNVYWNSSWSNKTYGDIWDNMTWMQWERETSNYT
EIIYELLEESQNQQEKNEQDLLALDRWNSLWNWFNITNWLWYIKIFIMIVGGLIGLRIIFAVLSLVNRVRQGYSPLS
LQTLIPSPRGPDRPGGIEEEGGEQDRNRSTRLVSGFLALVWDDLRSLCLFIYHRLRDFILIAARAGELLGRSSLKGL
RRGWEALKYLGSLVQYWGLELKRSAISLLDTLAIAVGEGTDRILEFVLGICRAIRNIPTRIRQGFETALL*
>703010505.w4.38
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENIIVHLNESVKIECTRPNNKTRTSIRIGPGQAFYATGQVIGDIREA
YCNINESKWNETLQRVSKKLKEYPPHKNITFQPSSGGDLEITTHSFNCGGEFFYCNTSSLFNRTYMANSTDMANSTE
TNSTRTITIHCRIKQIINMWQEVGRAMYAPPIAGNITCISNITGLLLTRDGGKNNTETFRPGGGNMKDNWRSELYKY
KVVEVKPLGVAPTNARRRVVEREKRAVGMGAVFLGFLGAAGSTMGAASITLTVQARQLLSGIVQQQSNLLKAIEAQQ
HMLKLTVWGIKQLQARVLALERYLKDQQLLGMWGCSGKLICTTNVYWNSSWSNKTYGDIWDNMTWMQWEREISNYTE
IIYELLEESQNQQEKNEQDLLALDRWNSLWNWFNITNWLWYIKIFIMIVGGLIGLRIIFAVLSLVNRVRQGYSPLSL
QTLIPSPRGPDRPGGIEEEGGEQDRNRSTRLVSGFLALVWDDLRSLCLFIYHRLRDFILIAARAGELLGRSSLKGLR
RGWEALKYLGSLVQYWGLELKRSAISLLDTLAIAVGEGTDRILEFVLGICRAIRNIPTRIRQGFETALL*
>703010505.w7.6
MRVMGIQRNYPQWWIWSMLGFWMLMICNGMWVTVYYGVPVWKEAKTTLFCASDAKAYEKEVHNVWATHACVPTDPNP
QEMVLEKNVTENFNMWKNDMVDQMHEDVISLWDQSLKPCVKLTPLCVTLNCTNATASNSSIIEGMKNCSFNITTELR
DRREKKNALFYKLDIVQLDGNSSQYRLINCNTSVITQACPKVSFDPIPIHYCAPAGYAILKCNNKTFTGTGPCNNVS
TVQCTHGIKPVVSTQLLLNGSLAEGEIIRSENITKNVKTIIVHLNESVKIECTRPNNKTRTSIRIGPGQAFYATGQ
VIGDIREAYCNINESKWNETLQRVSKKLKEYFPHKNITFQPSSGGDLEITTHSFNCGGEFFYCNTSSLFNRTYMANS
TDMANSTETNSTRTITIRCRIKQIINMWQEVGRAMYAPPIAGNITCISNITGLLLTRDGGKNNTETFRPGGGNMKDN
WRSELYKYKVVEVKPLGVAPTNARRRVVEREKRAVGMGAVPLGFLGAAGSTMGAASITLTVQARQLLSGIVQQQSNL
LKAIEAQQHMLKLTVWGIKQLQARVLALERYLKDQQLLGMWGCSGKLICTTNVYWNSSWSNKTYGDIWDNMTWMQWE
REISNYTEIIYELLEESQNQQEKNEQDLLALDRWNSLWNWFNITNWLWYIKIFIMIVGGLIGLRIIFAVLSLVNRVR
QGYSPLSLQTLIPSPRGPDRPGGIEEEGGEQDRNRSTRLVSGFLALVWDDLRSLCLFIYHRLRDFILIAARAGELLG
RSSLKGLRRGWEALKYLGSLVQYWGLELKRSAISLLDTLAIAVGEGTDRILEFVLGICRAIRNIPTRIRQGFETALL
*
>703010505.w7.33
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w7.30
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNETYMANST
DMANSTETNSIRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQEMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFTYHRLRDFILIAAPTGELLGR
SSLKGLRRGWEALKYLGSLVQYWGLELKRSAISLLDTLAIAVGEGTDRILEFVLGICRAIRNIPTRIRQGFETALL*
>703010505.w7.27
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSIRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w7.14

FIG. 17A cont'd

MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSARTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w7.8
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIECRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAAPAGELLGR
SSLKGLRRGWEALKYLGSLVQYWGLELKRSAISLLDTLAIAVGEGTDRILEFVLGICRAIRNIPTRIRQGFETALL*
>703010505.w7.15
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSARTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w7.13
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITHNVKTIIVHLNESVKIECMRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSARTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w7.18
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSARTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAAPAGELLGR
SSLKGLRRGWEALKYLGSLVQYWGLELKRSAISLLDTLAIAVGEGTDRILEFVLGICRAIRNIPTRIRQGFETALL*
>703010505.w7.9
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSIRTITIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ

FIG. 17A cont'd

```
GYSPLSLQTLIPSPRGPDRPGGIEEEGGEQDRNRSTRLVSGFLALVWDDLRSLCLFIYHRLRDFILIAAPAGELLGR
SSLKGLRRGWEALKYLGSLVQYWGLELKRSAISLLDTLAIAVGEGTDRILEFVLGICRAIRNIPTRIRQGFETALL*
>703010505.w7.21
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNPTYMANST
DMANSTETNSTQTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w7.3
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSIETITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w7.26
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALKRYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w7.29
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVISTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFSPTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w7.28
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKISFDPIPIHYCAPAGYAILKCNNQTPTGTGPCNNVST
VQCTHGIKPVVSTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNPTYMANST
DMANSTETNNTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w7.5
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVISTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
```

FIG. 17A cont'd

KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w7.20
MRVMGIQRNYPQWWIWSMLGFWMLM#CNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNAKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDXGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAAPAGELLGR
SSLKGLRRGWEALKYLGSLVQYWGLELKRSAISLLDTLAIAVGEGTDRILEFVLGICRAIRNIPTRIRQGFETALL*
>703010505.w7.25
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSRIIEGMKNCSFNITTELRD
KREKKNALFYKLDIVQLDGNSSQYRLINCNTSVITQACPKVSFDPIPIHYCAPAGYAILKCNNXTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNPTYMANST
DMANSTETNSTRTIIIHCRIKQIINMWQEVGRAMYAPPIAGNITCISNITGLLLTRDGGKNNMTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGTKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGC
SSLKGLRRGWEALKYLGSLVQYWGLELKRSAISLLDTLAIAVGEGTDRILEFVLGICRAIRNIPTRIRQGFETALL*
>703010505.w7.34
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTIITIHCRIKQIINMWQEVGRAMYAPPIAGSITCISNITGLLLTRDGGKNNMETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w7.2
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLPNRTYMANST
DMANSTETNSTRTITIHCRIKQIINMWQEVGRAMYAPPIAGNITCMSNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w7.12
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSIRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w7.32
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNXTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST

FIG. 17A cont'd

```
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w7.19
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
RREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
YMANSTETNSTRTITIRCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w7.31
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRYENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTEPNSTRTITLHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w7.11
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
RREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIRCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w7.7
MRVMGIQRNYPQWWIWSMLGFWMLMICNGMWVTVYYGVPVWKEAKTTLFCASDTKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALLFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNVYWNSSWSNKTYGDIWDNMTWMQWEREISNYTEIIYELLEESQNQQEKNEQDLLAL
DRWNSLWNWFNITNWLWYIKIFIMIVGGLIGLRIIPAVLSLVNRVRQGYSPLSLQTLIPSPRGPDRPGGIEEEGGEQ
DRNRSTRLVSGFLALVWDDLRSLCLFIYHRLRDFILIAARAGELLGRSSLKGLRRGWEALKYLGSLVQYWGLELKRS
AISLLDTLAIAVGEGTDRILEFVLGICRAIRNIPTRIRQGFETALL*
>703010505.w7.10
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNAKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNVYWNSSWSNKTYGDIWDNMTWMQWEREISNYTEIIYELLEESQNQQEKNEQDLLAL
DRWNSLWNWFNITNWLWYIKIFIMIVGGLIGLRIIFAVLSLVNRVRQGYSPLSLQTLIPSPRGPDRPGGIEEEGGEQ
DRNRSTRLVSGFLALVWDDLRSLCLFIYHRLRDFILIAARAGELLGRSSLKGLRRGWEALKYLGSLVQYWGLELKRS
AISLLDTLAIAVGEGTDRILEFVLGICRAIRNIPTRIRQGFETALL*
>703010505.w7.4
MRVMGIQRNYPQWWIWSMLGFWMLMICNGMWVTVYYGVPVWKEAKXTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
```

FIG. 17A cont'd

```
DMANSTETNSIRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w7.23
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNXNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSXRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w7.1
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNXNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w8.2
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITLHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVEQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRTIRNIPTRIRQGFETALL*
>703010505.w8.20
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNAKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITLHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w8.22
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIYCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQNNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w8.26
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
```

FIG. 17A cont'd

```
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSIRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w8.12
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w8.5
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTQTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPTPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w8.8
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSRIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w8.13
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSARTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w8.19
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTASLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGTDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w8.11
```

FIG. 17A cont'd

```
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSIRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w8.16
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSIRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTETIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w8.7
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSIRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPKGPDRPGGIEEEGGEQDRNRSTRLVSGFLALVWDDLRSLCLFIYHRLRDFILIAARAGELLGR
SSLKGLREGWEALKYLGSLVQYWGLELKRSAISLLDTLAIAVGEGTDRILEFVLGICRAIRNIPTRIRQGFETALL*
>703010505.w8.27
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTIPIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w8.15
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVISTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGRIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w8.6
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSARTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
```

FIG. 17A cont'd

```
GYSPLSLQTLIPSPRGPDRPGGIEEEGGEQDRNRSTRLVSGFLALVWDDLRSLCLFIYHRLRDFILIAAPAGELLGR
SSLKGLRRGWEALKYLGSLVQYWGLELKRSAISLLDTLAIAVGEGTDRILEFVLGICRAIRNIPTRIRQGFETALL*
>703010505.w8.18
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNPTYMANST
DMANSTETNSIRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNLPTRIRQGFETALL*
>703010505.w8.9
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSIRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNLPTRIRQGFETALL*
>703010505.w8.3
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSIRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w8.17
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSKRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w8.25
MRVMGIQRNYPQWWIWSMLGFWMLMICNGMWVTVYYGVPVWKEA#TTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNSTDMANST
ETNSTRIITIHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVFLGFLGAAGSTMGAASITLTVQARQLLSGIVQQQSNLLKAIEAQ
QHMLKLTVWGIKQLQARVLALERYLKDQQLLGMWGCSGKLICTTNVYWNSSWSNKTYGDIWDNMTWMQWEREISNYT
EIIYELLEESQNQQEKNEQDLLALDRWNSLWNWFNITNWLWYIKIFIMIVGGLIGLRIIFAVLSLVNRVRQGYSPLS
LQTLIPSPRGPDRPGGIEEEGGEQDRNRSTRLVSGFLALVWDDLRSLCLFIYHRLRDFILIAARAGELLGRSSLKGL
RRGWEALKYLGSLVQYWGLELKRSAISLLDTLAIAVGEGTDRILEFVLGICRAIRNIPTRIRQGFETALL*
>703010505.w8.28
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSIRTITIHCRIKQIINMWQEVGRAMYVPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
```

FIG. 17A cont'd

KAIEAQQHMLKLTVWGIKQLQARVLALERYLKDQQLLGMWGCSGKLICTTNVY*NSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w8.14
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
RREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITKNVKTIIVHLNESVKIECTRPNNKTRTXIRIGPGQAFYATGQV
IGDIREAYCNINESKWNETLQRVSKKLKEYFPHKNITFQPSSGGDLEITTHSFNCGGEPFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAAPAGELLGR
SSLKGLRRGWEALKYLGSLVQYWGLELKRSAISLLDTLAIAVGEGTDRILEFVLGICRAIRNIPTRIRQGFETALL*
>703010505.w8.1
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNPTYMANST
DMANSTETNSIRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w9.33
MRVMGIQRNYPQWWIWSMLGFWMLMICNGMWVTVYYGVPVWKEAKTTLSMLGF#DANDL*WD#WVTVYYGVPVWKEA
KTTLFCASDAKAYEKEVHNVWATHACVPTDPNPQEMVLKNVTENFNMWKNDMVDQMHEDVISLWDQSLKPCVKLTPL
CVTLNCTNATASSSSIIEGMKNCSFNITTELRDKREKKNALFYKLDIVQLDGNSSQYRLINCNTSVITQACPKVSFD
PIPIHYCAPAGYAILKCNNKTFTGTGPCNNVSTVQCTHGIKPVVSTQLLLNGSLAEGEIIRSENITNNVKTIIVHL
NESVKIECTRPNNKTRTSIRIGPGQAFYATGQVIGDIREAYCNINESKWNETLQRVSKKLKEYFPHKNITFQPSPGG
DLEITTHSFNCGGRPFYCNTSSLFNRTYMANSTDMANSTETNNTRTITIHCRIKQIINMWQEVGRAMYAPPIAGNIT
CISNITGLLLTRDGGKNNTETFRPGGGNMKDNWRSELYKYKVVEVKPLGVAPTNARERVVEREKRAVGMGAVFLGFL
GAAGSTMGAASITLTVQARQLLSGIVQQQSNLLKAIEAQQHMLKLTVWGIKQLQARVLALERYLKDQQLLGMWGCSG
KLICTTNVYWNSSWSNKTYGDIWDNMTWMQWEREISNYTEIIYELLEESQNQQEKNEQDLLALDRWNSLWNWFNITN
WLWYIKIFIMIVGGLIGLRIIFAVLSLVNRVRQGYSPLSLQTLIPSPRGPDEPGGIEEEGGEQDRNRSTRLVSGFLA
LVWDDLRSLCLFIYHRLRDFILIAARAGELLGRSSLKGLRRGWEALKYLGSLVQYWGLELKRSAISLLDTLAIAVGE
GTDRILEFVLGICRAIRNIPTRIRQGFETALL*
>703010505.w9.27
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITKVTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSIRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w9.19
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNGKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w9.4
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRYENITNNVKTIIVHLNESVKIECTRPNNKTRTSIRIGPGQAFYATGQV

FIG. 17A cont'd

```
IGDIREAYCNINESKWNETLQRVSKKLKEYFPHKNITFQPSSGGDLEITTHSFNCGGEFFYCNTSSLFNPTYMANST
DMANSTETNNTRTITIHCRIKQIINMWQEVGRAMYAPPIAGNITCISNITGLLLTRDGGKNNTETFRPGGGNMRDNW
RSELYKYKVVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIIIVGGLIGLRIIFAVLSLVNKVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w9.2
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNGKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRIITIHCRIKQIINMWQEVGRAMYAPPIAGNITCISNITGLLLTRDGGKNNTETFRPGGGNMKDNW
RSELYKYKVVVEVKPLGVAPTNARRPVVEREKGAVGMGAVFLGFLGAAGSTMGAASITLTVQARQLLSGIVQQQSNLL
KAIEAQQHMLKLTVWGIKQLQARVLALERYLKDQQLLGIWGCSGKLICTTNVYWNSSWSNKTYGDIWDNMTWMQWER
EISNYTEIIYELLEESQNQQEKNEQDLLALDRWNRLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w9.23
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNGKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRIITIHCRIKQIINMWQEVGRAMYAPPIAGNITCISNITGLLLTRDGGKNNTETFRPGGGNMKDNW
RSELYKYKVVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w9.7
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTQTITIHCRIKQIINMWQEVGRAMYAPPIAGNITCISNITRLLLTRDGGKNNTETFRPGGGNMKDNW
RSELYKYKVVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTINVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w9.1
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRYENITNNKVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNNTRTITIHCRIKQIINMWQEVGRAMYAPPIAGNITCISNITGLLLTRDGGKNNTETFRPGGGNMKDNW
RSELYKYKVVVEVKPLGVAPTNARRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w9.30
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRYENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w9.5
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
```

FIG. 17A cont'd

```
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSIRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPCGIEEEGGEQDRNRSTRLVSGFLALVWDDLRSLCLFIYHRLRDFILIAAPAGELLGR
SSLKGLRRGWEALKYLGSLVQYWGLELKRSAISLLDTLAIAVGEGTDRILEFVLGICRAIRNIPTRIRQGFETALL*
>703010505.w9.12
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSIRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQEMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVNGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w9.14
MRVMGIQRNYPQWWIWSMLGFWMLMICNGMWVTVYYGVPVWKEAKTTLFCASDAKAYEKEVHNVWATHACVPTDPNP
QEMVLKNVTENFNMRKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSIRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQEMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w9.9
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVISTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSIRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQEMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w9.24
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLILTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQEMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFTYHRLRDFILIAAPAGELLGR
SSLKGLRRGWEALKYLGSLVQYWGLELKRSAISLLDTLAIAVGEGTDRILEFVLGICRAIRNIPTRIRQGFETALL*
>703010505.w9.13
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNNTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQEMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLPIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w9.16
```

FIG. 17A cont'd

```
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYVANST
DMANSTETNSTRIITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w9.25
MGVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTQTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGVAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAAPAGELLGR
SSLKGLRRGWEALKYLGSLVQYWGLELKRSAISLLDTLAIAVGEGTDRILEFVLGICRAIRNIPTRIRQGFETALL*
>703010505.w9.3
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSIRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w9.32
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRIITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w9.22
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASLTLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w9.21
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVMSLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSIRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
```

FIG. 17A cont'd

```
GYSPLSLQTLIPSPRGPDRPGGIEEEGGEQDRNRSTRLVSGFLALVWDDLRSLCLFIYHRLRDFILIAAPAGELLGR
SSLKGLRRGWEALKYLGSLVQYWGLELKRSAISLLDTLAIAVGEGTDRILEFVLGICRAIRNIPTRIRQGFETALL*
>703010505.w9.31
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSIRTITIHCRIKQIINMWQEVGRAMYAPPIAGNITCISNITGLLLTRDGGKNNTETFRPGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w9.20
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKSTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIRCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w9.16
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
ETNNTRTITIHCRIKQIINMWQEVGRAMYAPPIAGNITCISNITGLLLTRDGGKNNTETFRPGGGNMKDNWRSELYK
YKVVEVKPLGVAPTNVYWNSSWSNKTYGDIWDNMTWMQWEREISNYTEIIYELLEESQNQQEKNEQDLLALDRWNSL
WNWFNITNWLWYIKIFIMIVGGLIGLRIIFAVLSLVNRVRQGYSPLSLQTLIPSPRGPDRPGGIEEEGGEQDRNRST
RLVSGFLALVWDDLRSLCLFIYHRLRDFILIAARAGELLGRSSLKGLRRGWEALKYLGSLVQYWGLELKRSAISLLD
TLAIAVGEGTDRILEFVLGICRAIRNIPTRIRQGFETALL*
>703010505.w9.11
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSXRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w9.28
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSXRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w10.8
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLRRVSKKLKEYFPHKNITFQPSSGGDLEITTHSFNCGGEFFYCNTSSLFNRTYMANST
DMANSTETNSARTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
```

FIG. 17A cont'd

EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVVGICRAIRNIPTRIRQGFETALL*
>703010505.w10.9
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSH#TITIHCRIKQIINMWQEVGRAMYAPPIAGNITCISNITGLLLTRDGGKNNTET
FRPGGGNMKDNWRSELYKYKVVEVKPLGVAPTNARRRVVEREKRAVGMGAVFLGFLGAAGSTMGAASITLTVQARQL
LSGIVQQQSNLLKAIEAQQHMLKLTVWGIKQLQARVLALERYLKDQQLLGMWGCSGKLICTTNVYWNSSWSNKTYGD
IWDNMTWMQWEREISNYTEIIYELLEESQNQQEKNEQDLLALDRWNSLWNWFNITNWLWYIKIFIMIVGGLIGLRII
FAVLSLVNRVRQGYSPLSLQTLIPSPRGPDRPGGIEEEGGEQDRNRSTRLVSGFLALVWDDLRSLCLFIYHRLRDFI
LIAARAGELLGRSSLKGLRRGWEALKYLGSLVQYWGLELKRSAISLLDTLAIAVGEGTDRILEFVLGICRAIRNIPT
RIRQGFETALL*
>703010505.w10.1
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
RREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNGTRTITIRCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w10.28
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNNTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w10.2
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNNTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWDWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGERTDRILEFVLGICRAIRNIPTRIRQGFETALL*
>703010505.w10.12
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITINCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w10.32
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTVTIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER

FIG. 17A cont'd

```
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w10.31
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNGKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRIITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w10.5
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNKVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSARTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w10.15
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSKRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w10.18
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRIITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w10.21
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNNTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w10.27
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISL*DQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNAKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
```

FIG. 17A cont'd

```
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w10.26
MRVMGIQRNYPQWWIWSMLGFWMLMICNGMWVTVYYGVPVWKEAKTTLFCASDTKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLKESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIPCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w10.24
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNGKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITYLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w10.7
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITINCRIKQIINMWQEVGRAMYAPPIAGNITCISNITGLILTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w10.16
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIRCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w10.20
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITKNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITITCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w10.13
MRVMGIQRNYPQWWIWSMLGFWMLMICNGMWVTVYYGVPVWKEAKTTLFCASDAKAYEKEVHNVWATHACVPTDPNP
QEMALKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
```

FIG. 17A cont'd

```
IGDIREAYCNINESKWNETLQRVSKKLKEYFPHKNITFQPSSGGDLEITTHSFNCGGEFFYCNTSSLFNPTYMANST
DMANSTETNSIRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVPLGFLGAAGSTMGAASITLTVQARQLLSGIVQQQSNLL
KAIEAQQEMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIRIFIMIVGGLIGLEIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w10.22
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNGKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTEIITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVPLGFLGAAGSTMGAASITLTVQARQLLSGIVQQQSNLL
KAIEAQQEMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNRLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLEDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w10.26
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNGKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRIITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVPLGFLGAAGSTMGAASITLTVQARQLLSGIVQQQSNLL
KAIEAQQEMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNRLWNGFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w14.29
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTIKIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVPLGFLGAAGSTMGAASVYLTVQARQLLSGIVQQQSNLL
KAIEAQQEMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAIGEGTDRILEFVLGICRAIRNIPTRIRQGFETALL*
>703010505.w14.3
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYVILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTIKIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVPLGFLGAAGSTMGAASITLTVQARQLLSGIVQQQSNLL
KAIEAQQEMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILKFVLGICRAIRNIPTRIRQGFETALL*
>703010505.w14.30
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTIKIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVPLGFLGAAGSTMGAASITLTVQARQLLSGIVQQQSNLL
KAIEAQQEMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILKFVLGICRAIRNIPTRIRQGFETALL*
>703010505.w14.32
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
```

FIG. 17A cont'd

```
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTIKIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAAPAGELLGR
SSLKGLRRGWEALKYLGSLVQYWGLELKRSAISLLDTLAIAVGEGTDRILKFVLGICRAIRNIPTRIRQGFETALL*
>703010505.w14.22
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNPTYMANST
DMANSTETNSTRTIKIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNK#YGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILKFVLGICRAIRNIPTRIRQGFETALL*
>703010505.w14.34
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTIKIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILKFVLGICRAIRNIPTRIRQGFETALL*
>703010505.w14.16
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTIKIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTINVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w14.31
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTIKIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAAPAGELLGR
SSLKGLRRGWEALKYLGSLVQYWGLELKRSAISLLDTLAIAVGEGTDRILEFVLGICRAIRNIPTRIRQGFETALL*
>703010505.w14.4
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTIKIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w14.6
```

FIG. 17A cont'd

MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTIKIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w14.20
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTIKIHCRIKQIINMWQEVGRAMYAPPIAGNITCISNITGLLLTRDGGKNNTETFRPGGGNMKDNW
RSELYKYKVVEVKPLGVAPTNARRRVVEKEKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAAPAGELLGR
SSLKGLRRGWEALKYLGSLVQYWGLELKRSAISLLDTLAIAVGEGTDRILEFVLGICRAIRNIPTRIRQGFETALL*
>703010505.w14.39
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTIKIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKRLRRGWEALKYLGNLVQYWGLELKRSAISLLDTLAIAVGEGTDRILEFVLGICRAIRNIPTRIEQGFETALL*
>703010505.w14.30
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTVTIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w14.19
MRVMGIQRNYPQWWIWSMLGFWMLMICNGMWVTVYYGVPVWKEAKTTLFCASDTKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRP#NNKTRTSIRIGPGQAFYATGQ
VIGDIREAYCNINESKWNETLQRVSKKLKEYFPHKNITFQPSSGGDLEITTHSFNCGGEFFYCNTSSLFNRTYMANS
TDMANSTETNSTRTITIRCRIKQIINMWQEVGRAMYAPPIAGNITCISNITGLLLTRDGGKNNTETFRPGGGNMKDN
WRSELYKYKVVEVKPLGVAPTNARRRVVEREKRAVGMGAVFLGFLGAAGSTMGAASITLTVQARQLLSGIVQQQSNL
LKAIEAQQHMLKLTVWGIKQLQARVLALERYLKDQQLLGMWGCSGKLICTTNVYWNSSWSNKTYGDIWDNMTWMQWE
REISNYTEIIYELLEESQNQQEKNEQDLLALDRWNSLWNWFNITNWLWYIKIFIMIVGGLIGLRIIFAVLSLVNRVR
QGYSPLSLQTLIPSPRGPDRPGGIEEEGGEQDRNRSTRLVSGFLALVWDDLRSLCLFIYHRLRDFILIAARAGELLG
RSSLKGLRRGWEALKYLGSLVQYWGLELKRSAISLLDTLAIAVGEGTDRILEFVLGICRAIRNIPTRIRQGFETALL
*
>703010505.w14.2
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIPCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ

FIG. 17A cont'd

```
GYSPLSLQTLIPSPRGPDRPGGIEEEGGEQDRNRSTRLVSGFLALVWDDLRSLCLFIYHRLRDFILIAAPAGELLGR
SSLKGLRRGWEALKYLGSLVQYWGLELKRSAISLLDTLAIAVGEGTDRILEFVLGICRAIRNIPTRIRQGFETALL*
>703010505.w14.17
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIХCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILKFVLRICRAIRNIPTRIEQGFETALL*
>703010505.w14.21
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNGKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRIITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQAKVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEDGGEQDRNRSTRLVSGFLALVWDDLRSLCLFIYHRLEDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w14.11
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCITLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNGKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRIITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLSDTLAIAVGEGTDRILEFVLGICRAIRNIPTRIRQGFETALL*
>703010505.w14.10
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCITLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNGKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRIITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLSDTLAIAVGEGTDRILEFVLGICRAIRNIPTRIRQGFETALL*
>703010505.w14.15
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCITLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNGKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRIITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLSDTLAIAVGEGTDRILEFVLGICRAIRNIPTRIRQGFETALL*
>703010505.w14.13
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIRAAYCNINESKWNETLQRVSKKLKEYFPHKNITFQPSPGGDLEITTHSFNCGGEFFYCNTSSLFNRTYMANST
DMANSTETNNTRTITIHCRIKQIINMWQEVGRAMYAPPIAGNITCISNITGLLLTRDGGKNNAETFRPGGGNMKDNW
RSELYKYKVVEVKPLGVAPTNARRRVVEREKRAVGMGAVFLGFLGAAGSTMGAASITLTVQARQLLSGIVQQQSNLL
```

FIG. 17A cont'd

```
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w14.12
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIRAAYCNINESKWNETLQRVSKKLKEYFPHKNITFQPSPGGDLEITTHSFNCGGEPFYCNTSSLFNRTYMANST
DMANSTETNNTRTITIHCRIKQIINMWQEVGRAMYAPPIAGNITCISNITGLLLTRDGGKNNAETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAAPAGELLGR
SSLKGLRRGWEALKYLGSLVQYWGLELKRSAISLLDTLAIAVGEGTDRILEFVLGICRAIRNIPTRIRQGFETA#
>703010505.w14.8
MRVMGIQRNYPQWWIWSMLGFWMLMICNGMWVTVYYGVPVWKEAKTTLFCASDAKAYEKEVHNVWATHACVPTDPNP
QEMFLKNVTENFNMWKNDMVDQMHEDVISLWDQSLKPCVKLTPLCVTLNCTNATASNSSIIERMKNCSFNITTELRD
KREKKNALFYKLDIVQLDGNSSQYRLINCNTSVITQACPKVSFDPIPIHYCAPAGYAILKCNNXTFTGTGPCNNVST
VQCTHGIKPVVSTQLLLNGSLAEGEIIIRSENITNNVKTIIVHLNESVKIECTRPNNKTRASIRIGPGQAFYATGQV
IGDIREAYCNINESKWNETLQRVSKKLKEYFPHKNITFQPSSGGDLEITTHSFNCGGEFFYCNTSSLFNPTYMANST
DMANSTETNSTRTITIRCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIPAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w14.36
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESIKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIRCRIKQIINMWQEVGRAMYAPPIAGNITCISNITGLLLTRDGGKNNTETFRPGGGNMKDNW
RSELYKYKVVEVKPLGVAPTNVYWNSSWSNKTYGDIWDNMTWMQWEREISNYTEIIYELLEESQNQQEKNEQDLLAL
DRWNSLWNWFNITNWLWYIKIFIMIVGGLIGLRIIFAVLSLVNRVRQGYSPLSLQTLIPSPRGPDRPGGIEEEGGEQ
DRNRSTRLVSGFLALVWDDLRSLCLFIYHRLRDFILIAARAGELLGRSSLKGLRRGWEALKYLGSLVQYWGLELKRS
AISLLDTLAIAVGEGTDRILEFVLGICRAIRNIPTRIRQGFETALL*
>703010505.w14.35
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESIKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTITIRCRIKQIINMWQEVGRAMYAPPIAGNITCISNITGLLLTRDGGKNNTETFRPGGGNMKDNW
RSELYKYKVVEVKPLGVAPTNVYWNSSWSNKTYGDIWDNMTWMQWEREISNYTEIIYELLEESQNQQEKNEQDLLAL
DRWNSLWNWFNITNWLWYIKIFIMIVGGLIGLRIIFAVLSLVNRVRQGYSPLSLQTLIPSPRGPDRPGGIEEEGGEQ
DRNRSTRLVSGFLALVWDDLESLCLFIYHRLRDFILIAARAGELLGRSSLKGLRRGWEALKYLGSLVQYWGLELKRS
AISLLDTLAIAVGEGTDRILEFVLGICRAIRNIPTRIRQGFETALL*
>703010505.w20.10
MRVMGIQRNYPQWWINMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLFPCVTLNCTNATINSSIIEGMKNCSFNITTELRD
KREKKNALFYKLDIVQLDGNSSQYRLINCNTSVITQACPKVSFDPIPIHYCAPAGYAILKCNNXTFTGTGPCNNVST
VQCTHGIKPVVSTQLLLNGSLAEGEIIIRSENITNNGKTIIVHLNESVKIECTRPNNKTRTSIRIGPGQAFYATGQV
IGDIREAYCNISESKWNETLQRVSKKLKEYFPHKNITFQPSSGGDLEITTHSFNCGGEFFYCNTSSLFNPTYMANST
DMANSTETNSTRTITIRCRIKQIINMWQEVGRAMYAPPIAGNITCISNITGLLLTRDGGKNNTETFRPGGGNMKDNW
RSELYKYKVVEVKPLGVAPTNVYWNSSWSNKTYGDIWDNMTWMQWEREISNYTEIIYELLEESQNQQEKNEQDLLAL
DRWNSLWNWFNITNWLWYIKIFIMIVGGLIGLRIIFAVLSLVNRVRQGYSPLSLQTLIPSPRGPDRPGGIEEEGGEQ
DRNRSTRLVSGFLALVWDDLRSLCLFIYHRLRDFILIAARAGELLGRSSLKGLRRGWEALKYLGSLVQYWGLELKRS
AISLLDTLAIAVGEGTDRILEFVLGICRAIRNIPTRIRQGFETALL*
>703010505.w20.33
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATACNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNAKTIIVHLNESVKIECTRPNNKTRTSIRIGPGQAFYATGQV
IGDIREAYCNISESKWNETLQRVSKKLKEYFPHKNITFQPSSGGDLEITTHSFNCGGE#FFYCNTSSLFNRTYMANS
TDMANSTETNNTRTITIHCRIKQIINMWQEVGRAMYAPPIAGNITCISNITGLLLTRDGGKNNTETFRPGGGNMKDN
WRSELYKYKVVEVKPLGVAPTNVYWNSSWSNKTYGDIWDNMTWMQWEREISNYTEIIYELLEESQNQQEKNEQDLLA
LDRWNSLWNWFNITNWLWYIKIFIMIVGGLIGLRIIFAVLSLVNRVRQGYSPLSLQTLIPSPRGPDRPGGIEREGGE
```

FIG. 17A cont'd

QDRNRSTRLVSGFLALAWDDLRSLCLFIYHRLRDFILIAARAGELLGRSSLKGLRRGWEALKYLGSLVQYWGLELKR
SAISLLDTLAIAVGEGTDRILEFVLGICRAIRNIPTRIRQGFETALL*
>703010505.w20.2
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATANNSNIIEEMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNFTDMANST
ETNNTRTITIHCRIKQIINMWQEVGRAMYAPPIAGNITCISNITGLLLTRDGGKNNTETFRPGGGNMKDNWRSELYK
YKVVEVKPLGVAPTNARRRVVEREKRAVGMGAVPLGFLGAAGSTMGAASITLTVKARQLLSGIVQQQSNLLKAIEAQ
QHMLKLTVWGIKQLQARVLALERYLKDQQLLGMWGCSGKLICTTNVYWNSSWSNKTYGDIWDNMTWMQWEREISNYT
EIIYELLEESQNQQEKNEQDLLALDRWNSLWNWFNITNWLWYIKIFIMIVGGLIGLRIIFAVLSLVNRVRQGYSPLS
LQTLIPSPRGPDRPGGIEEEGGEQDRNRSTRLVSGFLALVWDDLRSLCLFIYHRLRDFILIAARAGELLGRSSLKGL
RRGWEALKYLGSLVQYWGLELKRSAISLLDTLAIAVGEGTDRILEFVLGICRAIRNIPTRIRQGFETALL*
>703010505.w20.36
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSNIIEEMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTETIKIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVPLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILKFVLGICRAIRNIPTRIRQGFETALL*
>703010505.w20.22
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATTSNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNVKTIIVHLNESVKIECTRPNNKTRTSIRIGPGQAFYATGQV
IGDIREAYCNISESKWNETLQRVSKKLKEYFPHKNITFQPSSGGDLEITTHSFNCGGEFFYCNTSSLFNRTYMANST
DMANSTETNSTRTITIHCRIKQIINMWQEVGRAMYAPPIAGNITCISNITGLLLTRDGGKNNTETFRPGGGNMKDNW
RSELYKYKVVEVKPLGAAPTNARRRVVEREKRAVGMGAVPLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGGLVQYWGLELKRSAISLLDTLAIAVGEGTDRILEFVLGICRAIRNIPTRIRQGFETALL*
>703010505.w20.12
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWD*SLKPCVKLTPLCVTLNCTNATANNSSIIEGMKNCSFNITTELRD
KREKKNVLFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNAKTIIVHLNESVKIECTRPNNKTRTSIRIGPGQAFYATGQV
IGDIREAYCNISESKWNETLQRVSKKLKEYFPHKNITFQPSSGGDLEITTHSFNCGGEFFYCNTSSLFNFTYMANST
DMANSTETNSTRIITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVPLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIVVGEGTDRILEFVLGICRAIRNIPTRIRQGFETALL*
>703010505.w20.7
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNANASNSNIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNGKTIIVHLNESVKIECTRPNNKTRTSIRIGPGQAFYATGQV
IGDIREAYCNISESKWNETLQRVSKKLKEYFPHKNITFQPSSGGDLEITTHSFNCGGEFFYCNTSSLFNFTYMANST
DMANSTETNSTRIITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVPLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFTLIAARAGELLGR
SSLKGLRRGWEALKYLGSLVQYWGLELKRSAISLLDTLAIAVGEGTDRILEFVLGICRAIRNIPTRIRQGFETALL*
>703010505.w20.26
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNISIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNGKTIIVHLNESVKIECTRPNNKTRTSIRIGPGQAFYATGQV
IGDIREAYCNISESKWNETLQRVSKKLKEYFPPHKNITFQPSSGGDLEITTHSFNCGGEFFYCNTSSLFNRTYMANST
DMANSTETNSTRIITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVPLGFLGAAGSTMGAASITLTVQARQLLSGIVQQQSNLL

FIG. 17A cont'd

KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w20.4
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATANNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNGKTIIVHLNESVKIECTRPNNXTRTSIRIGPGQAFYATGQV
IGDIREAYCNISESKWNETLQRVSKKLKEYFPHKNITFQPSSGGDLEITTHSFNCGGEFFYCNTSSLFNRTYMANST
DMANSTETNSTRTITIRCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFTYHRLRDFILIAAPAGELLGR
SSLKGLRRGWEALKYLGSLVQYWGLELKRSAISLLDTLAIAVGEGTDRILEFVLGICRAIRNIPTRIRQGFETALL*
>703010505.w20.30
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATANNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNAKTIIVHLNESVKIECTRPNNKTRTSIRIGPGQAFYATGQV
IGNIREAYCNISESKWNETLQRVSKKLKEYFPHKNITFQPSSGGDLEITTHSFNCGGEFFYCNTSSLFNPTYMANST
DMANSTETNSTRTITLHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNRLWNWFNITNWLWYIKIFIMIVGGLIGLRIIFAVLSLVNRVRQ
GYSPLSLQTLIPSPRGPDRPGEIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w20.8
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATANNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNAKTIIVHLNESVKIECTRPNNKTRTSIRIGPGQAFYATGQV
IGNIREAYCNISESKWNETLQRVSKKLKEYFPHKNITFQPSSGGDLEITTHSFNCGGEFFYCNTSSLFNRTYMANST
DMANSTETNSTETITLHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w20.27
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATANNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNAKTIIVHLNESVKIECTRPNNKTRTSIRIGPGQAFYATGQV
IGDIRKAYCNINESKWNETLQRVSKKLKEYFPHKNITFQPSSGGDLEITTHSFNCGGEFFYCNTSSLFNRTYMANST
DMANSTETNSTRTITLHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w20.14
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNAKTIIVHLNESVKIECTRPNNKTRTSIRIGPGQAFYATGQV
IGDIRKAYCNISESKWNETLQRVSKKLKEYFPHKNITFQPSSGGDLEITTHSFNCGGEFFYCNTSSLFNRTYMANST
DMANSTETNSTRTITLHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w20.15
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATTSNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNISESKWNETLQRVSKKLKEYFPHKNITFQPSSGGDLEITTHSFNCGGEFFYCNTSSLFNRTYMANST

FIG. 17A cont'd

```
DMANSTETNNTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w20.29
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATTSNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRTIKIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w20.11
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATTSNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IRNIREAYCNINESKWNETLQRVSKKLKEYFPHKNITFQPSSGGDLEITTHSFNCGGEFFYCNTSSLFNRTYMANST
DMANSTETNSTRTIKIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w20.32
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATTSNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGNIREAYCNINESKWNETLQRVSKKLKEYFPHKNITFQPSSGGDLEITTHSFNCGGEFFYCNTSSLFNRTYMANST
DMANSTETNSTRTIKIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w20.23
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATTSNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNAKTIIVHLNESVKIECTRPNNKTRTSIRIGPGQAFYATGQV
IGDIRKAYCNINESKWNETLQRVSKKLKEYFPHKNITFQPSSGGDLEITTHSFNCGGEFFYCNTSSLFNRTYMANST
DMANSTETNNTRTITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRR
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w20.24
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATTSNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNVKTIIVHLNESVKIECTRPNNKTRTSIRIGPGQAFYATGQV
IGDIRKAYCNINESKWNETLQRVSKKLKEYFPHKNITFQPSSGGDLEITTHSFNCGGEFFYCNTSSLFNRTYMANST
DMANSTETNSTRTITIRCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALAWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w20.9
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNAASNSSIIEGMKNCSFNITTELRDK
REKKNALFYKLDIVQLDGNSSQYRLINCNTSVITQACPKVSFDPIPIHYCAPAGYAILKCNNKTFTGTGPCNNVSTV
```

FIG. 17A cont'd

QCTHGIKPVVSTQLLLNGSLAEGEIIIRSENITNNAKTIIVHLNESVKIECTRPNNKTRTSIRIGPGQAFYATGQVI
GDIRKAYCNINESKWNETLQRVSKKLKEYFPHKNITFQPSSGGDLEITTHSFNCGGEFFYCNTSSLFNRTYMANSTD
MANSTETNNTRTITIHCRIKQIINMWQEVGRAMYAPPIAGNITCISNITGLLLTRDGGKNNTETFRPGGGNMKDNWR
SELYKYKVVEVKPLGVAPTNARRRVVEREKRAVGMGAVPLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNKTYGDIWDNMTWMQWERE
ISNYTEIIYELLEESQNQQEKNEQDLLALDRWNSLWNWFNITNWLWYIKIFIMIVGGLIGLRIIFAVLSLVNRVRQG
YSPLSLQTLIPSPRGPDRPGGIEEEGGEQDRNRSTRLVSGFLALAWDDLRSLCLFIYHRLRDFILIAARAGELLGRS
SLKGLRRGWEALKYLGSLVQYWGLELKRSAISLLDTLAIAVGEGTDRILEFVLGICRAIRNIPTRIRQGFETALL*
>703010505.w20.21
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNAASNSSIIEGMKNCSFNITTELRDK
REKKNALFYKLDIVQLDGNSSQYRLINCNTSVITHACPKVSFDPIPIHYCAPAGYAILKCNNKTFTGTGPCNNVSTV
QCTHGIKPVVSTQLLLNGSLAEGEIIIRSENITNNAKTIIVHLNESVKIECTRPNNKTRTSIRIGPGQAFYATGQVI
GDIRKAYCNINESKWNETLQRVSKKLKEYFPHKNITFQPSSGGDLEITTHSFNCGGEFFYCNTSSLFNRTYMANSTD
MANSTETNNTRTITIHCRIKQIINMWQEVGRAMYAPPIAGNITCISNITGLLLTRDGGKNNTETFRPGGGNMKDNWR
SELYKYKVVEVKPLGVAPTNARRRVVEREKRAVGMGAVPLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNKTYGDIWDNMTWMQWERE
ISNYTEIIYELLEESQNQQEKNEQDLLALDRWNSLWNWFNITNWLWYIKIFIMIVGGLIGLRIIFAVLSLVNRVRQG
YSPLSLQTLIPSPRGPDRPGGIEEEGGEQDRNRSTRLVSGFLALAWDDLRSLCLFIYHRLRDFILIAARAGELLGRS
SLKGLRRGWEALKYLGSLVQYWGLELKRSAISLLDTLAIAVGEGTDRILEFVLGICRAIRNIPTRIRQGFETALL*
>703010505.w20.6
MRVMGIQRNYPQWWIWSMLGFWMLMICNGMWVTVYYGVPVWKEAKTTLFCASDAKAYEKEVHNVWATHACVPTDPNP
QEMVLEKNVTEDPNMWKNDMVDQMHEDVISLWDQSLKPCVKLTPLCVTLNCTNANASNSSIIEGMKNCSFNITTELR
DKREKKNALFYKLDIVQLDGNSSQYRLINCNTSVITQACPKVSFDPIPIHYCAPAGYAILKCNNKTFTGTGPCNNVS
TVQCTHGIKPVVSTQLLLNGSLAEGEIIIRSENITNNGKTIIVHLNESVKIECTRPNNKTRTSIRIGPGQAFYATGQ
VIGDIREAYCNISESKWNETLQRVSKKLKEYFPHKNITFQPSSGGDLEITTHSFNCGGEFFYCNTSSLFNRTYMANS
TDMANSTETNRTITIHCRIKQIINMWQEVGRAMYAPPIAGNITCISNITGLLLTRDGGKNNTETFRPGGGNMKDNWR
SELYKYKVVEVKPLGVAPTNARRRVVEREKRAVGMGAVPLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNKTYGDIWDNMTWMQWERE
ISNYTEIIYELLEESQNQQEKNEQDLLALDRWNSLWNWFNITNWLWYIKIFIMIVGGLIGLRIIFAVLSLVNRVRQG
YSPLSLQTLIPSPRGPDRPGGIEEEGGEQDRNRSTRLVSGFLALVWDDLRSLCLFIYHRLRDFTLIAARAGELLGRS
SLKGLERGWEALKYLGSLVQYWGLELKRSAISLLDTLAIAVGEGTDRILEFVLGICRAIRNIPTRIRQGFETALL*
>703010505.w20.19
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNATASNSSIIEGMKNCSFNIT
TELRDKREKKNALFYKLDIVQLDGNSSQYRLINCNTSVITQACPKVSFDPIPIHYCAPAGYAILKCNNKTFTGTGPC
NNVSTVQCTHGIKPVVSTQLLLNGSLAEGEIIIRSENITNNVKTIIVHLNESVKIECTRPNNKTRKSIRIGPGQAFY
ATGQVIGDIREAYCNISESKWNETLQRVSKKLKEYFPHKNITFQPSSGGDLEITTHSFNCGGEFFYCNTSSLFNRTY
MANSTDMANSTETNSTRTITIRCRIKQIINMWQEVGRAMYAPPIAGNITCISNITGLLLTRDGGKNNTETFRPGGGN
MKDNWRSELYKYKVVEVKPLGVAPTNARRRVVEREKRAVGMGAVPLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYGDIWDNMTW
MQWEREISNYTEIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALVWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w20.25
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNATASNSSIIEGMKNCSFNIT
TELRDKREKKNALFYKLDIVQLDGNSSQYRLINCNTSVITQACPKVSFDPIPIHYCAPAGYAILKCNNKTFTGTGPC
NNVSTVQCTHGIKPVVSTQLLLNGSLAEGEIIIRSENITNNVKTIIVHLNESVKIECTRPNNKTRKSIRIGPGQAFY
ATGQVIGDIREAYCNINESKWNETLQRVSKKLKEYFPHKNITFQPSSGGDLEITTHSFNCGGEFFYCNTSSLFNRTY
MANSTDMANSTETNSTRTITIRCRIKQIINMWQEVGRAMYAPPIAGNITCISNITGLLLTRDGGKNNTETFRPGGGN
MKDNWRSELYKYKVVEVKPLGVAPTNARRRVVEREKRAVGMGAVPLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYGDIWDNMTW
MQWEREISNYTEIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALVWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w20.13
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNATASNSSIIEGMKNCSFNIT
TELRDKREKKNALFYKLDIVQLDGNSSQYRLINCNTSVITQACPKVSFDPIPIHYCAPAGYAILKCNNKTFTGTGPC
NNVSTVQCTHGIKPVVSTQLLLNGSLAEGEIIIRSENITNNVKTIIVHLNESVKIECTRPNNKTRKSIRIGPGQAFY
ATGQVIGDIREAYCNINESKWNETLQRVSKKLKEYFPHKNITFQPSSGGDLEITTHSFNCGGEFFYCNTSSLFNRTY
MANSTDMANSTETNSTRTITIRCRIKQIINMWQEVGRAMYAPPIAGNITCISNITGLLLTRDGGKNNTETFRPGGGN
MKDNWRSELYKYKVVEVKPLGVAPTNARRRVVEREKRAVGMGAVPLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYGDIWDNMTW
MQWEREISNYTEIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALVWDDLRSLCLFIYHRLRDFILIAARAG

FIG. 17A cont'd

ELLGRSSLKGLRRGWEALKYLGSLVQYWGLELKRSAISLLDTLAIAVGEGTDRILEFVLGICRAIRNIPTRIRQGFE
TALL*
>703010505.w20.34
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNATASNSSIIEGMKNCSFNIT
TELRDRREKKNALFYKLDIVQLDGNSSQYRLINCNTSVITQACPKVSFDPIPIHYCAPAGYAILKCNNKTFTGTGPC
NNVSTVQCTHGIKPVVSTQLLLNGSLAEGEIIIRSENITNNAKTIIVHLNESVKIECTRPNNKTRTSIRIGPGQAFY
ATGQVIGDIRAAYCNINESKWNETLQRVSKKLKEYFPHKNITFQPSSGGDLEITTHSFNCGGEFFYCNTSSLFNRTY
MANSTDMANSTETNSTRTITIRCRIKQIINMWQEVGRAMYAPPIAGNITCISNITGLLLTRDGGKNNTETFRPGGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYGDIWDNMTW
MQWEREISNYTEIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEGGEQDRNRSTRLVSGFLALVWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w20.28
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNTNATASNSSIIEGMKNCSFN
ITTELRDREREKKNALFYKLDIVQLDGNSSQYRLINCNTSVITQACPKVSFDPIPIHYCAPAGYAILKCNNKTFTGTG
PCNNVSTVQCTHGIKPVVSTQLLLNGSLAEGEIIIRSENITNNAKTIIVHLNESVKIECTRPNNKTRTSIRIGPGQA
FYATGQVIGDIREAYCNIESKWNETLQRVSKKLKEYFPHKNITFQPSSGGDLEITTHSFNCGGEFFYCNTSSLFNR
TYMANSTDMANSTETNSTRTITIRCRIKQICINMWQEVGRAMYAPPIAGNITCISNITGLLLTRDGGKNNTETFRPGG
GNMKDNWRSELYKYKVVEVKPLGVAPTNARRRVVEREKRAVGMGAVFLGFLGAAGSTMGAASITLTVQARQLLSGIV
QQQSNLLKAIEAQQHMLKLTVWGIKQLQARVLALERYLKDQQLLGMWGCSGKLICTTNVYWNSSWSNKTYGDIWDNM
TWIQWEREISNYTEIIYELLEESQNQQEKNEQDLLALDRWNSLWNWFNITNWLWYIKIFIMIVGGLIGLRIIFAVLS
LVNRVRQGYSPLSLQTLIPSPRGPDRPGGIEEGGEQDRNRSTRLVSGFLALVWDDLRSLCLFIYHRLRDFILIAAR
AGELLGRSSLKGLRRGWEALKYLGSLVQYWGLELKRSAISLLDTLAIAVGEGTDRILEFVLGICRAIRNIPTRIRQG
FETALL*
>703010505.w20.3
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNTNATASNSSIIEGMKNCSFN
ITTELRDKREKKNALFYKLDIVQLDGNSSQYRLINCNTSVITQACPKVSFDPIPIHYCAPAGYAILKCNNKTFTGTG
PCNNVSTVQCTHGIKPVVSTQLLLNGSLAEGEIIIRSENITNNAKTIIVHLNESVKIECTRPNNKTRTSIRIGPGQA
FYATGQVIGNIREAYCNISESKWNETLQRVSKKLKEYFPHKNITFQPSSGGDLEITTHSFNCGGEFFYCNTSSLFNR
TYMANSTDMANSTETNSTRIITIHCRIKQIINMWQEVGRAMYAPPIAGNITCISNITGLLLTRDGGKNNTETFRPGG
GNMKDNWRSELYKYKVVEVKPLGVAPTNARRRVVEREKRAVGMGAVFLGFLGAAGSTMGAASITLTVQARQLLSGIV
QQQSNLLKAIEAQQHMLKLTVWGIKQLQARVLALERYLKDQQLLGMWGCSGKLICTTNVYWNSSWSNKTYGDIWDNM
TWIQWEREISNYTEIIYELLEESQNQQEKNEQDLLALDRWNSLWNWFNITNWLWYIKIFIMIVGGLIGLRIIFAVLS
LANRVRQGYSPLSLQTLIPSPRGPDRPGGIEEGGEQDRNRSTRLVSGFLALVWDDLRSLCLFIYHRLRDFILIAAR
AGELLGRSSLKGLRRGWEALKYLGSLVQYWGLELKRSAISLLDTLAIAVGEGTDRILEFVLGICRAIRNIPTRIRQG
FETALL*
>703010505.w22.20
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNTNATANNSSIIEGMKNCSFN
ITTELRDKREKKNALFYKLDIVQLDGNSSQYRLINCNTSVITQACPKVSFDPIPIHYCAPAGYAILKCNNKTFTGTG
PCNNVSTVQCTHGIKPVVSTQLLLNGSLAEGEIIIRSENITNNAKTIIVHLNESVKIECTRPNNKTRTSIRIGPGQA
FYATGQVIGDIREAYCNISESKWNETLQRVSKKLKEYFPHKNITPQPSSGGDLEITTHSFNCGGEFFYCNTSSLFNR
TYMANSTDMANSTETNSTRTITIRCRIKQIINMWQEVGRAMYAPPIAGNITCISNITGLLLTRDGGKNNTETFRPGG
GNMKDNWRSELYKYKVVEVKPLGVAPTNARRRVVEREKRAVGMGAVFLGFLGAAGSTMGAASITLTVQARQLLSGIV
QQQSNLLKAIEAQQHMLKLTVWGIKQLQARVLALERYLKDQQLLGMWGCSGKLICTTNVYWNSSWSNKTYGDIWDNM
TWMQWEREISNYTEIIYELLEESQNQQEKNEQDLLALDRWNSLWNWFNITNWLWYIKIFIMIVGGLIGLRIIPAVLS
LVNRVRQGYSPLSLQTLIPSPRGPDRPGGIEEGGEQDRNRSTRLVSGFLALVWDDLRSLCLFIYHRLRDFILIAAR
AGELLGRSSLKGLRRGWEALKYLGSLVQYWGLELKRSAISLLDTLAIAVGEGTDRILEFVLGICRAIRNIPTRIRQG
FETALL*
>703010505.w22.6
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNATASNSSIIEGMKNCSFNIT
TELRDKREKKNALFYKLDIVQLDGNSSQYRLINCNTSVITQACPKVSFDPIPIHYCAPAGYAILKCNNKTFTGTGPC
NNVSTVQCTHGIKPVVSTQLLLNGSLAEGEIIIRSENITNNAKTIIVHLNESVKIECTRPNNKTRTSIRIGPGQAFY
ATGQVIGDIREAHCNISESKWNETLQRVSKKLKEYFPHKNITFQPSSGGDLEITTHSFNCGGEFFYCNTSSLFNRTY
MANSTDMANSTETNSTRIITIHCRIKQIINMWQEVGRAMYAPPIAGNITCISNITGLLLTRDGGKNNTETFRPGGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYGDIWDNMTW
MQWEREISNYTEIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEGGEQDRNRSTRLVSGFLALVWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w22.7
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNATASNSSIIEGMKNCSFNIT

FIG. 17A cont'd

```
TELRDKREKKNALFYKLDIVQLDGNSSQYRLINCNTSVITQACPKVSFDPIPIHYCAPAGYAILKCNNKTFTGTGPC
NNVSTVQCTHGIKPVVSTQLLLNGSLAEGEIIIRSENITNNAKTIIVHLNESVKIECTRPNNKTRTSIRIGPGQAFY
ATGQVIGDIREAHCNISESKWNETLQRVSKKLKEYFPHKNITFQPSSGGDLEITTHSPNCGGEFFYCNTSSLFNRTY
MANSTDMANSTETNSTRIITIHCRIKQIINNMWQEVGRAMYAPPIAGNITCISNITGLLLTRDGGKNNTETFPRGGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYGDIWDNMTW
MQWEREISNYTEIIYELLEESQNQQEKNEQDLLALDRWNSLWNWFNITNWLWYIKIFIMIVGGLIGLRIIFAVLSLV
NPVRQGYSPLSLQTLIPSPRGPDRPGGIEEEGGEQDRNRSTRLVSGFLALVWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w22.10
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATMATASNSSIIEGMKNCSFNITTE
LRDKREKKNALFYKLDIVQLDGNSSQYRLINCNTSVITQACPKVSFDPIPIHYCAPAGYAILKCNNKTFTGTGPCN
NVSTVQCTHGIKPVVSTQLLLNGSLAEGEIIIRSENITNNGKTIIVHLNESVKIECTRPNNKTRTSIRIGPGQAFYA
TGQVIGDIREAYCNISESKWNETLQRVSKKLKEYFPHKNITFQPSSGGDLEITTHSPNCGGEFFYCNTSSLFNRTYM
ANSTDMANSTETNSTRIITIHCRIKQIINNMWQEVGRAMYAPPIAGNITCISNITGLLLTRDGGKNNTETFRPGGGNM
KDNWRSELYKYKVVEVKPLGVAPTNARRRVVEREKRAVGMGAVFLGFLGAAGSTMGAASITLTVQARQLLSGIVQQQS
NLLKAIEAQQHMLKLTVWGIKQLQARVLALERYLKDQQLLGMWGCSGKLICTTNVYWNSSWSNKTYGDIWDNMTWM
QWEREISNYTEIIYELLEESQNQQEKNEQDLLALDRWNSLWNWFNITNWLWYIKIFIMIVGGLIGLRIIFAVLSLVN
RVRQGYSPLSLQTLIPSPRGPDRPGGIEEEGGEQDRNRSTRLVSGFLALVWDDLRSLCLFIYHRLRDFILIAARAGE
LLGRSSLKGLRRGWEALKYLGSLVQYWGLELKRSAISLLDTLAIAVGEGTDRILEFVLGICRAIRNIPTRIRQGFET
ALL*
>703010505.w22.11
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATNATASNSSIIEGMKNCSFNITTE
LRDKREKKNALFYKLDIVQLDGNSSQYRLINCNTSVITQACPKVSFDPIPIHYCAPAGYAILKCNNKTFTGTGSCNN
VSTVQCTHGIKPVVSTQLLLNGSLAEGEIIIRSENITNNKTIVHLNESVKIECTRPNNKTRTSIRIGPGQAFYAT
GQVIGDIREAYCNISESKWNETLQRVSKKLKEYFPEKNITFQPSSGGDLEITTHSPNCGGEFFYCNTSSLFNRTYMA
NSTDMANSTETNSTRIITIHCRIKQIINMWQEVGRAMYAPPIAGNITCISNITGLLLTRDGGKNNTETFPRGGGNMK
DNWRSELYKYKVVEVKPLGVAPTNARRRVVEREKRAVGMGAVFLGFLGAAGSTMGAASITLTVQARQLLSGIVQQQS
KLLKAIEAQQHMLKLTVWGIKQLQARVLALERYLKDQQLLGNWGCSGKLICTTNVYWNSSWSNKTYGDIWDNMTWMQ
WEREISNYTEIIYELLEESQNQQEKNEQDLLALDRWNSLWNWFNITNWLWYIKIFIMIVGGLIGLRIIFAVLSLVNR
VRQGYSPLSLQTLIPSPRGPDRPGGIEEEGGEQDRNRSTRLVSGFLALVWDDLRSLCLFIYHRLRDFILIAARAGEL
LGRSSLKGLRRGWEALKYLGSLVQYWGLELKRSAISLLDTLAIAVGEGTDRILEFVLGICRTIRNIPTRIRQGFETA
LL*
>703010505.w22.13
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATNATASNSSIIEGMKNCSFNITTE
LRDKREKKNALFYKLDIVQLDGNSSQYRLINCNTSVITQACPKVSFDPIPIHYCAPAGYAILKCNNKTFTGTGSCNN
VSTVQCTHGIKPVVSTQLLLNGSLAEGEIIIRSENITNNGKTIIVHLNESVKIECTRPNNKTRTSIRIGPGQAFYAT
GQVIGDIREAYCNISESKWNETLQRVSKKLKEYFPEKNITFQPSSGGDLEITTHSPNCGGEFFYCNTSSLFNRTYMA
NSTDMANSTETNSTRIITIHCRIKQIINMWQEVGRAMYAPPIAGNITCISNITGLLLTRDGGKNNTETFPRGGGNMK
DNWRSELYKYKVVEVKPLGVAPTNARRRVVEREKRAVGMGAVFLGFLGAAGSTMGAASITLTVQARQLLSGIVQQQS
NLLKAIEAQQHMLKLTVWGIKQLQARVLALERYLKDQQLLGNWGCSGKLICTTNVYWNSSWSNKTYGDIWDNMTWMQ
WEREISNYTEIIYELLEESQNQQEKNEQDLLALDRWNSLWNWFNITNWLWYIKIFIMIVGGLIGLRIIFAVLSLVNR
VRQGYSPLSLQTLIPSPRGPDRPGGIEEEGGEQDRNRSTRLVSGFLALVWDDLRSLCLFIYHRLRDFILIAARAGEL
LGRSSLKGLRRGWEALKYLGSLVQYWGLELKRSAISLLDTLAIAVGEGTDRILEFVLGICRAIRNIPTRIRQGFETA
LL*
>703010505.w22.16
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATNATASNSSIIEGMKNCSFNITTE
LRDKREKKNALFYKLDIVQLDGNSSQYRLINCNTSVITQACPKVSFDPIPIHYCAPAGYAILKCNNKTFTGTGPCNN
VSTVQCTHGIKPVVSTQLLLNGSLAEGEIIIRSENITNNGKTIIVHLNESVKIECTRPNNKTRTSIRIGPGQAFYAT
GQVIGDIREAYCNISESKWNETLQRVSKKLKEYFPEKNITFQPSSGGDLEITTHSPNCGGEFFYCNTSSLFNRTYMA
NSTDMANSTETNSTRIITIHCRIKQIINMWQEVGRAMYAPPIAGNITCISNITGLLLTRDGGKNNTETFPRGGGNMK
DNWRSELYKYKVVEVKPLGVAPTNARRRVVEREKRAVGMGAVFLGFLGAAGSTMGAASITLTVQARQLLSGIVQQQS
NLLKAIEAQQHMLKLTVWGIKQLQARVLALERYLKDQQLLGNWGCSGKLICTTNVYWNSSWSNKTYGDIWDNMTWMQ
WEREISNYTEIIYELLEESQNQQEKNEQDLLALDRWNSLWNWFNITNWLWYIKIFIMIVGGLIGLRIIFAVLSLVNR
VRQGYSPLSLQTLIPSPRGPDRPGGIEEEGGEQDRNRSTRLVSGFLALVWDDLRSLCLFIYHRLRDFILIAARAGEL
LGRSSLKGLRRGWEALKYLGSLVQYWGLELKRSAISLLDTLAIAVGEGTDRILEFVLGICRAIRNIPTRIRQGFETA
LL*
>703010505.w22.17
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATTNATASNSSIIEGMKNCSFNITT
ELRDKREKKNALFYKLDIVQLDGNSSQYRLINCNTSVITQACPKVSFDPIPIHYCAPAGYAILKCNNKTFTGTGPCN
NVSTVQCTHGIKPVVSTQLLLNGSLAEGEIIIRSENITNNGKTIIVHLNEPVKIECTRPNNKTRTSIRIGPGQAFYA
TGQVIGDIREAYCNISESKWNETLQRVSKKLKEYFPHKNITFQPSSGGDLEITTHSPNCGGEFFYCNTSSLFNRTYM
ANSTDMANSTETNSTRIITIHCRIKQIINMWQEVGRAMYAPPIAGNITCISNITGLLLTRDGGKNNTETFRPGGGNM
KDNWRSELYKYKVVEVKPLGVAPTNARRRVVEREKRAVGMGAVFLGFLGAAGSTMGAASITLTVQARQLLSGIVQQQ
```

FIG. 17A cont'd

```
SNLLKAIEAQQHMLKLTVWGIKQLQARVLALERYLKDQQLLGMWGCSGKLICTTNVYWNSSWSNKTYGDIWDNMTWM
QWEREISNYTEIIYELLEESQNQQEKNEQDLLALDRWNSLWNWFNITNWLWYIKIFIMIVGGLIGLRIIFAVLSLVN
RVRQGYSPLSLQTLIPSPRGPDRPGGIEEEGGEQDRNRSTRLVSGFLALVWDDLRSLCLFIYHRLRDFILIAARAGE
LLGRSSLKGLRRGWEALKYLGSLVQYWGLELKRSAISLLDTLAIVVGEGTDRILEFVLGICRAIRNIPTRIRQGFET
ALL*
>703010505.w22.18
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATTNATASNSSIIEGMKNCSFNVTT
ELRDKREKKNALFYKLDIVQLDGNSSQYRLINCNTSVITQACPKVSFDPIPIHYCAPAGYAILKCNNKTFTGTGPCN
NVSTVQCTHGIKPVVSTQLLLNGSLAEGEIIIRSENITNNGKTIIVHLNESVKIECTRPNNKTRTSIRIGPGQAFYA
TGQVIGDIREAYCNISESKWNETLQRVSKKLKEYFPHKNITFQPSSGGDLEITTHSFNCGGEFFYCNTSSLFNRTYM
ANSTDMANSTETNSTRTITIRCRIKQIINMWQEVGRAMYAPPIAGNITCISNITGLLLTRDGGKNNTETFRPGGGNM
KDNWRSELYKYKVVEVKPLGVAPTNARRRVVEREKRAVGMGAVFLGFLGAAGSTMGAASITLTVQARQLLSGIVQQQ
SNLLKAIEAQQHMLKLTVWGIKQLQARVLALERYLKDQQLLGMWGCSGKLICTTNVYWNSSWSNKTYGDIWDNMTWM
QWEREISNYTEIIYELLEESQNQQEKNEQDLLALDRWNSLWNWFNITNWLWYIKIFIMIVGGLIGLRIIFAVLSLVN
RVRQGYSPLSLQTLIPSPRGPDRPGGIEEEGGEQDRNRSTRLVSGFLALVWDDLRSLCLFIYHRLRDFILIAARAGE
LLGRSSLKGLRRGWEALKYLGSLVQYWGLELKRSAISLLDTLAIAVGEGTDRILEFVLGICRAIRNIPTRIRQGFET
ALL*
>703010505.w22.1
MRVMGIQRNHPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATTNATASNSSIIEGMKNCSFNITT
ELRDKREKKNALFYKLDIVQLDGNSSQYRLINCNTSVITQACPKVSFDPIPIHYCAPAGYAILKCNNKTFTGTGPCN
NVSTVQCTHGIKPVVSTQLLLNGSLAEGEIIIRSENITNNAKTIIVHLNESVKIECTRPNNKTRTSIRIGPGQAFYA
TGQVIGDIREAYCNISESKWNETLQRVSKKLKEYFPHKNITFQPSSGGDLEITTHSFNCGGEFFYCNTSSLFNRTYM
ANSTDMANSTETNSTRTITIRCRIKQIINMWQEVGRAMYAPPIAGNITCISNITGLLLTRDGGKNNTETFRPGGGNM
KDNWRSELYKYKVVEVKPLGVAPTNARRRVVEREKRAVGMGAVFLGFLGAAGSTMGAASITLTVQARQLLSGIVQQQ
SNLLKAIEAQQHMLKLTVWGIKQLQARVLALERYLKDQQLLGMWGCSGKLICTTNVYWNSSWSNKTYGDIWDNMTWM
QWEREISNYTEIIYELLEESQNQQEKNEQDLLALDRWNSLWNWFNITNWLWYIKIFIMIVGGLIGLRIIFAVLSLVN
RVRQGYSPLSLQTLIPSPRGPDRPGGIEEEGGEQDRNRSTRLVSGFLALVWDDLRSLCLFIYHRLRDFILIAARAGE
LLGRSSLKGLRRGWEALKYLGSLVQYWGLELKRSAISLLDTLAIAVGEGTDRILEFVLGICRAIRNIPTRIRQGFET
ALL*
>703010505.w22.5
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATTNATASNSSIIEGMKNCSFNITT
ELRDKREKKNALFYKLDIVQLDGNSSQYRLINCNTSVITQACPKVSFDPIPIHYCAPAGYAILKCNNKTFTGTGPCN
NVSTVQCTHGIKPVVSTQLLLNGSLAEGEIIIRSENITNNAKTIIVHLNESVKIECTRPNSKTRTSIRIGPGQAFYA
TGQVIGDIREAYCNISESKWNETLQRVSKKLKEYFPHKNITFQPSSGGDLEITTHSFNCGGEFFYCNTSSLFNRTYM
ANSTDMANSTETNSTRTITIRCRIKQIINMWQEVGRAMYAPPIAGNITCISNITGLLLTRDGGKNTETFRPGGGNM
KDNWRSELYKYKVVEVKPLGVAPTNARRRVVEREKRAVGMGAVFLGFLGAAGSTMGAASITLTVQARQLLSGIVQQQ
SNLLKAIEAQQHMLKLTVWGIKQLQARVLALERYLKDQQLLGMWGCSGKLICTTNVYWNSSWSNKTYGDIWDNMTWM
QWEREISNYTEIIYELLEESQNQQEKNEQDLLALDRWNSLWNWFNITNWLWYIKIFIMIVGGLIGLRIIFAVLSLVN
RVRQGYSPLSLQTLIPSPRGPDRPGGIEEEGGEQDRNRSTRLVSGFLALVWDDLRSLCLFIYHRLRDFILIAARAGE
LLGRSSLKGLRRGWEALKYLGSLVQYWGLELKRSAISLLDTLAITVGEGTDRILEFVLGICRAIRNIPTRIRQGFET
ALL*
>703010505.w22.19
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATTNATASNSSIIEGMKNCSFNITT
ELRDKREKKNALFYKLDIVQLDGNSSQYRLINCNTSVITQACPKVSFDPIPIHYCAPAGYAILKCNNKTFTGTGPCN
NVSTVQCTHGIKPVVSTQLLLNGSLAEGEIIIRSENITNNGKTIIVHLNESVKIECTRPNNKTRTSIRIGPGQAFYA
TGQVIGDIREAYCNISESKWNETLQRVSKKLKEYFPHKNITFQPSSG#DLEITTHSFNCGGEFFYCNTSSLFNRTYM
ANSTDMANSTETNSTRTITIRCRIKQIINMWQEVGRAMYAPPIAGNITCISNITGLLLTRDGGKNTETFRPGGGNM
KDNWRSELYKYKVVEVKPLGVAPTNARRRVVEREKRAVGMGAVFLGFLGAAGSTMGAASITLTVQARQLLSGIVQQQ
SNLLKAIEAQQHMLKLTVWGIKQLQARVLALERYLKDQQLLGMWGCSGKLICTTNVYWNSSWSNKTYSDIWDNMTWM
QWEREISNYTEIIYELLEESQNQQEKNEQDLLALDRWNSLWNWFNITNWLWYIKIFIMIVGGLIGLRIIFAVLSLVN
RVRQGYSPLSLQTLIPSPRGPDRPGGIEEEGGEQDRNRSTRLVSGFLALVWDDLRSLCLFIYHRLRDFILIAARAGE
LLGRSSLKGLRRGWEALKYLGSLVQYWGLELKRSAISLLDTLAIAVGEGTDRILEFVLGICRAIRNIPTRIRQGFET
ALL*
>703010505.w22.15
MRVMGIQRNYPQWWIWSMLGFWMLMICNGMWVTVYYGVPVWKEAKTTLFCASDAKAYEKEVHNVWATYACVPTDPNP
QEMVLKNVTENFNMWKNDMVDQMHEDVISLWDQSLKPCVKLTPLCVTLNCTNATAGNSSIIESMKNCSFNITTELRD
KREKKNALFYKLDIVQLDGNSSQYRLINCNTSVITQACPKVSFDPIPIHYCAPAGYAILKCNNKTFTGTGPCMNVST
VQCTHGIKPVVSTQLLLNGSLAEGEIIIRSENITNNAKTIIVHLNESVKIECTRPNNKTRTSIRIGPGQAFYATGQV
IGDIREAYCNISESKWNETLQRVSKKLKEYFPHKNITFQPSSGGDLEITTHSFNCGGEFFYCNTSSLFNRTYMANST
DMANSTETNSTRTITIRCRIRQTINMWQEVGRAMYAPPIAGNITYISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLEIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGGLVQYWGLELKRSAISLLDTLAIAVGEGTDRILEFVLGICRAIRNIPTRIRQGFETALL*
>703010505.w22.9
```

FIG. 17A cont'd

```
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIEGMKNCSFNITTELRDK
REKKNALFYKLDIVQLDGNSSQYRLINCNTSVITQACPKVSFDPIPIHYCAPAGYAILKCNNKTFTGTGPCNNVSTV
QCTHGIKPVVSTQLLLNGSLAEGEIIRSENITNNGKTIIVHLNESVKIECTRPNNKTRTSIRIGPGQAFYATGQVI
GDIREAYCNISESKWNETLQRVSKKLKEYFPHKNITFQPSSGGDLEITTHSFNCGGEFFYCNTSSLFNRTYMANSTD
MANSTETNSTRIITIHCRIKQIINMWQEVGRAMYAPPIAGNITCISNITGLLLTRDGGKNNTETFRPGGGNMKDNWR
SELYKYKVVEVKPLGVAPTNARRRVVEREKRAVGMGAVFLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNKTYGDIWDNMTWMQWERE
ISNYTEIIYELLEESQNQQEKNEQDLLALDRWNSLWNWFNITNWLWYIKIFIMIVGGLIGLRIIFAVLSLVNRVRQG
YSPLSLQTLIPSPRGPDRPGGIEEEGGEQDRNRSTRLVSGFLALVWDDLRSLCLFIYHRLRDFILIAARAGELLGRS
SLKGLRRGWEALKYLGSLVQYWGLELKRSTISLLDTLAIAVGEGTDRILEFVLGICRAIRNIPTRIRQGFETALL*
>703010505.w22.22
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEEMKNCSFNIITELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIRSENITNNVKTIIVHLNESVKIECTRPNNKTRTSIRIGPGQAFYATGQV
IGDIREAYCNINESKWNETLQRVSKKLKEYFPHKNITFQPSSGGDLEITTHSFNCGGEFFYCNTSSLFNRTYMANST
DMANSTETNSTRNITIHCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAPAGELLGR
SSLKGLRRGWEALKYLGSLVQYWGLELKRSAISLLDTLAIAVGEGTDRILEFVLGICRAIRNIPTRIRQGFETALL*
>703010505.w22.26
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSFNITTE
LRDKREKKNALFYKLDIVQLDGNSSQYRLINCNTSVITQACPKVSFDPIPIHYCAPAGYAILKCNNKTFTGTGSCNN
VSTVQCTHGIKPVVSTQLLLNGSLAEGEIIRSENITNNGKTIIVHLNESVKIECTRPNNKTRTSIRIGPGQAFYAT
GQVIGDIREAYCNISESKWNETLQRVSKKLKEYFPHKNITFQPSSGGDLEITTHSFNCGGEFFYCNTSSLFNRTYMA
NSTDMANSTETNSTRIITIHCRIKQIINMWQEVGRAMYAPPIAGNITCISNITGLLLTRDGGKNNTETFRPGGGNMK
DNWRSELYKYKVVEVKPLGVAPTNARRRVVEREKRAVGMGAVFLGFLGAAGSTMGAASITLTVQARQLLSGIVQQQS
NLLKAIEAQQHMLKLTVWGIKQLQARVLALERYLKDQQLLGMWGCSGKLICTTNVYWNSSWSNKTYGDIWDNMTWMQ
WEREISNYTEIIYELLEESQNQQEKNEQDLLALDRWNSLWNWFNITNWLWYIKIFIMIVGGLIGLS#IIFAVLSLVN
RVRQGYSPLSLQTLIPSPRGPDRPGGIEEEGGEQDRNRSTRLVSGFLALVWDDLRSLCLFIYHRLRDFILIAARAGE
LLGRSSLKGLRRGWEALKYLGSLVQYWGLELKRSAISLLDTLAIAVGEGTDRILEFVLGICRAIRNIPTRIRQGFET
ALL*
>703010505.w22.24
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIEGMKNCSFNITTELRDK
REKKNAPFYKLDIVQLDGNSSQYRLINCNTSVITQACPKVSFDPIPIHYCAPAGYAILKCNNKTFTGTGPCNNVSTV
QCTHGIKPVVSTQLLLNGSLAEGEIIRSENITNNGKTIIVHLNESVKIECTRPNNKTRTSIRIGPGQAFYATGQVI
GDIREAYCNISESKWNETLQRVSKKLKEYFPHKNITFQPSSGGDLEITTHSFNCGGEFFYCNTSSLFNRTYMANSTD
MANSTETNSKRTITIHCRIKQIINMWQEVGRAMYAPPIAGNITCISNITGLLLTRDGGKNNTETFRPGGGNMKDNWR
SELYKYKVVEVKPLGVAPTNARRRVVEREKRAVGMGAVFLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNKTYGDIWDNMTWMQWERE
ISNYTEIIYELLEESQNQQEKNEQDLLALDRWNSLWNWFNITNWLWYIKIFIMIVGGLIGLRIIFAVLSLVNRVRQG
YSPLSLQTLIPSPRGPDRPGGIEEEGGEQDRNRSTRLVSGFLALVWDDLRSLCLFIYHRLRDFILIAARAGELLGRS
SLKGLRRGWEALKYLGSLVQYWGLELKRSAISLLDTLAIAVGEGTDRILEFVLGICRAIRNIPTRIRQGFETALL*
>703010505.w22.23
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNATASNSSIIEGMKNCSFNIT
TELRDKREKKNALFYKLDIVQLDGNSSQYRLINCNTSVITQACPKVSFDPIPIHYCAPAGYAILKCNNKTFTGTGPC
NNVSTVQCTHGIKPVVSTQLLLNGSLAEGEIIRSENITNNGKTIIVHLNESVKIECTRPNNKTRTSIRIGPGQAFY
ATGQVIGDIREAYCNISESKWNETLQRVSKKLKEYFPHKNITFQPSSGGDLEITTHSFNCGGEFFYCNTSSLFNRTY
MANSTDMANSTETNSTRTITIRCRIKQIINMWQEVGRAMYAPPIAGNITCISNITGLLLTRDGGKNNTETFRPGGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYGDIWDNMTW
MQWEREISNYTEIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w30.22
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATNATASNSSIIEGMKNCSFNITTE
LRDKREKKNALFYKLDIVQLDGNSSQYRLINCNTSVITQACPKVSFDPIPIHYCAPAGYAILKCNNKTFTGTGPCNN
VSTVQCTHGIKPVVSTQLLLNGSLAEGEIIRSENITNNDKTIIVHLNESVKIECTRPSNKTRTSIRIGPGQAFYAT
GQVIGDIREAYCNISESKWNETLQRVSKKLKEYFPHKNITFQPSSGGDLEITTHSPNCGGEFFYCNTSSLFNRTYMA
NSTDM#CRIKQIINMWQEVGRAMYAPPIAGNITCISNITGLLLTRDGGKNNTETFRPGGGNMKDNWRSELYKYKVVE
VKPLGVAPTNARRRVVEREKRAVGMGAVFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNKTYGDIWDNMTWMQWEREISNYTEIIYE
```

FIG. 17A cont'd

```
LLEESQNQQEKNEQDLLALDRWNSLWNWFNITNWLWYIKIFIMIVGGLIGLRIIFAVLSLVNRVRQGYSPLSLQTLI
PSPRGPDRPGGIEEEGGEQDRNRSTRLVSGFLALVWDDLRSLCLFIYHRLRDFILIAARAGELLGRSSLKGLRRGWE
ALKYLGSLVQYWGLELKRSAISLLDTLAIAVGEGTDRILEFVLGICRAIRNIPTRIRQGFETALL*
>703010505.w30.11
MRVMGIQRNYPQWWIWSMLGFWMLMICKGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATAS#ISVIEEMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITDNVKTIIVHLNESVKIECTRPNNKTRTSIRIGPGQAFYATGQV
IGDIREAYCNISESKWNETLQRVSKKLKEYFPEKNITFQPSSGGDLEITTHSFNCGGEFFYCNTSSLFNRTYMANST
ETNSTRTITIRCRIKQIINMWQEVGRAMYAPPIAGNITCISNITGLLLTRDGGKNNTDTETFRPGGGNMKDNWRSEL
YKYKVVEVKPLGVAPTNARRRVVEREKRAVGMGAVFLGFLGAAGSTMGAASITLTVQARQLLSGIVQQQSNLLKAIE
AQQHMLKLTVWGIKQLQARVLALERYLKDQQLLGMWGCSGKLICTTNVYWNSSWSNKTYGDIWDNMTWMQNEREISN
YTEIIYELLEESQNQQEKNEQDLLALDRWNSLWNWFNITNWLWYIKIFIMIVGGLIGLRIIFAVLSLVNRVRQGYSP
LSLQTLIPSPRGPDRPGGIEEEGGEQDRNRSTRLVSGFLALVWDDLRSLCLFIYHRLRDFILIAARAGELLGRSSLK
GLRRGWEALKYLGSLVQYWGLELKRSAISLLDTLAIAIGEGTDRILEFVLGICRAIRNIPTRIRQGFETALL*
>703010505.w30.20
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATTNATASNSSIIEGMKNCSFNITT
ELRDKREKKNALFYKLDIVQLDGNSSQYRLINCNTSVITQACPKVSFDPIPIHYCAPAGYAILKCNNKTFTGTGPCN
NVSTVQCTHGIKPVVSTQLLLNGSLAEGEIIISENITNNAKTIIVHLNESVKIECTRPNNKTRTSIRIGPGQAFYA
TGQVIGDIREAYCNISESKWNETLQRVSKKLKEYFPEKNITFQPSSGGDLEITTHSFNCGGEFFYCNTSSLFNRTYM
ANSTDMANSTETNSTRIITIHCRIKQIINMWQEVGRAMYAPPIAGNITCISNITGLLLTRDGGKNTRDGGKNNYTETF
RPGGGNMKDNWRSELYKYKVVEVKPLGVAPTNARRKVVEREKRAVGMGAVFLGFLGAAGSTMGAASITLTVQARQLL
SGIVQQQSNLLKAIEAQQHMLKLTVWGIKQLQARVLALERYLKDQQLLGMWGCSGKLICTTNVYWNSSWSNKTYGDI
WDNMTWMQWEREISNYTEIIYELLEESQNQQEKNEQDLLALDRWNSLWNWFNITNWLWYIKIFIMIVGGLIGLRIIF
AVLSLVNEVRQGYSPLSLQTLIPSPRGPDRPGGIEEEGGEQDRNRSTRLVSGFLALAWDDLRSLCLFIYHRLRDFIL
IAARAGELLGRSSLKGLRRGWEALKYLGSLVQYWGLELKRSAISLLDTLAIAVGEGTDRILEFVLGICRAIRNIPTR
IRQGFETALL*
>703010505.w30.12
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATNATASNSSIIEGMKNCSFNITTE
LRDKREKKNALFYKLDIVQLDGNSSQYRLINCNTSVITQACPKVSFDPIPIHYCAPAGYAILKCNNKTFTGTGPCNN
VSTVQCTHGIKPVVSTQLLLNGSLAEGEIIIRSENITNNDKTIIVHLNESVKIECTRPSNKTRTSIRIGPGQAFYAT
GQVIGDIREAYCNISESKWNETLQRVSKKLKEYFPEKNITFQPSSGGDLEITTHSFNCGGEFFYCNTSSLFNRTYMA
NSTDMANSTETNSTRNITIHCRIKQIINMWQEVGRAMYAPPIAGNITCISNITGLLLTRDGGKNDTETFRPGGGNMK
DNWRSELYKYKVVEVKPLGVAPTNARRRVVEREKRAVGMGAVFLGFLGAAGSTMGAASITLTVQARQLLSGIVQQQS
NLLKAIEAQQHMLKLTVWGIKQLQARVLALERYLKDQQLLGMWGCSGKLICTTNVYWNSSWSNKTYGDIWDNMTWMQ
NEREISNYTEIIYELLEESQNQQEKNEQDLLALDRWNSLWNWFNITNWLWYIKIFIMIVGGLIGLRIIFAVLSLVNR
VRQGYSPLSLQTLIPSPRGPDRPGGIEEEGGEQDRNRSTRLVSGFLALVWDDLRSLCLFIYHRLRDFILIAARAGEL
LGRSSLXGLRRGWEALKYLGSLVQYWGLELKRSAISLLDTLAIAVGEGTDRILEFILGICRAIRNIPTRIRQGFETA
LL*
>703010505.w30.17
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATNATASNSSIIEGMKNCSFNITTE
LRDKREKKNALFYKLDIVQLDGNSSQYRLINCNTSVITQACPKVSFDPIPIHYCAPAGYAILKCNNKTFTGTGSCNN
VSTVQCTHGIKPVVSTQLLLNGSLAEGEIIIRSENITDNGKTIIVRLNESVKIECTRPNNKTPTSIRIGPGQAFYAT
GQVIGDIKEAYCNISESKWNETLQRVSKKLKEYFPEKNITFQPSSGGDLEITTHSPNCGGEFFYCNTSSLFNRTYMA
NSTDMANSTETNSTRNICRIKQIINMWQEVGRAMYAPPIAGNITCISNITGLLLTRDGGKNNTDTETFRPGGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYGDIWDNMTW
MQWEREISNYTEIIYELLEESQNQQEKNEQDLLALDRWNSLWNWFNITNWLWYIKIFIMIVGGLIGLRIIPAVLSLV
NRVRQGYSPLSLQTLIPSPRGPDRPGGIEEEGGEQDRNRSTRLVSGFLALVWDDLRSLCLFIYHRLRDFILIAARAG
ELLGRSSLKGLRRGWEALKYLGSLVQYWGLELKRSAISLLDTLAIAIGEGTDRILEFVLGICRAIRNIPTRIRQGFE
TALL*
>703010505.w30.31
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATINATASNSSIIEGMKNCSFNITT
ELRDKREKKNALFYKLDIVQLDGNSSQYRLINCNTSVITQACPKVSFDPIPIHYCAPAGYAILKCNNKTFTGTGPCN
NVSTVQCTHGIKPVVSTQLLLNGSLAEGEIIIRSENITHVHLNESVKIECTRPSNKTRTSIRIGPGQAFYA
TGQVIGDIREAYCNISESKWNETLQRVSKKLKEYFPHKNITFQPSSGGDLEITTHSFNCGGEFFYCNTSSLFNRTYM
ANSTDMANSTETNSTRTITIRCRIKQIINMWQEVGRAMYAPPIAGNITCISNITGLLLTRDGGKNNTDTETFRPGGG
NNKDNWRSELYKYKVVEVKPLGVAPTNARRRVVEREKRAVGMGAVFLGFLGAAGSTMGAASITLTVQARQLLSGIVQ
QQSNLLKAIEAQQHMLKLTVWGIKQLQARVLALERYLKDQQLLGMWGCSGKLICTTNVYWNSSWSNKTYGDIWDNMT
WMQWEREISNYTEIIYELLEESQNQQEKNEQDLLALDRWNSLWNWFNITNWLWYIKIFIMIVGGLIGLRIIPAVLSL
VNRVRQGYSPLSLQTLIPSPRGPDRPGGIEEEGGEQDRNRSTRLVSGFLALVWDDLRSLCLFIYHRLRDFILIAARA
GELLGRSSLKGLRRGWEALKYLGSLVQYWGLELKRSAISLLDTLAITVGEGTDRILEFVLGICRAIRNIPTRIRQGF
ETALL*
>703010505.w30.6
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATTNATASNSSIIEGMKNCSFNITT
```

FIG. 17A cont'd

```
ELRDKREKKNALFYKLDIVQLDGNSSQYRLINCNTSVITQACPKVSFDPIPIHYCAPAGYAILKCNNKTFTGTGPCN
NVSTVQCTHGIKPVVSTQLLLNGSLAEGEIIIRSENITNNAKTIIVHLNESVKIECTRPSNKTRTSIRIGPGQAFYA
TGQVIGDIREAYCNISESKWNETLQRVSKKLKEYFPHKNITFQPSSGGDLEITTHSFNCGGEFFYCNTSSLFNRTYM
ANSTDMANSTETNSTRTITIRCRIKQIINMWQEVGRAMYAPPIAGNITCISNITGLLLTRDGGKNNTDTETFRPGGG
NMKDNWRSELYKYKVVEVKPLGVAPTNARRRVVEREKRAVGMGAVPLGFLGAAGSTMGAASITLTVQARQLLSGIVQ
QQSNLLKAIEAQQHMLKLTVWGIKQLQARVLALERYLKDQQLLGMWGCSGKLICTTNVYWNSSWSNKTYGDIWDNMT
WMQWEREISNYTEIIYELLEESQNQQEKNEQDLLALDRWNSLWNWFNITNWLWYIKVFIMIVGGLIGLRIIFAVLSL
VNRVRQGYSPLSLQTLIPSPRGPDRPGGIEEEGGEQDRNRSTRLVSGFLALVWDDLRSLCLFIYHRLRDFILIAARA
GELLGRSSLKGLREGWEALKYLGSLVQYWGLELKRSAISLLDTLAITVGEGTDRILEFVLGICRAIRNIPTRIRQGF
ETALL*
>703010505.w30.7
MRVMGIQRNYPQWWIWSMLGFWMLMICNGMWVTVYYGVPVWKEAKTTLFCASDAKAYEKEVHNVWATHACVPTDPNP
QEMVLKNVTENFNMW#NDMVDQMHEDVISLWDQSLKPCVKLTPLCVTLNCTNATTNATASNSSIIEGMKNCSFNITT
ELRDKREKKNALFYKLDIVQLDGNSSQYRLINCNTSVITQACPKVSFDPIPIHYCAPAGYAILKCNNKTFTGTGPCN
NVSTVQCTHGIKPVVSTQLLLNGSLAEGEIIIRSENITNNAKTIIVHLNESVKIECTRPSNKTRTSIRIGPGQAFYA
TGQVIGDIREAYCNISESKWNETLQRVSKKLKEYFPHKNITFQPSSGGDLEITTHSFNCGGEFFYCNTSSLFNRTYM
ANSTDMANSTETNSTRTITIRCRIKQIINMWQEVGRAMYAPPIAGNITCISNITGLLLTRDGGKNNTDTETFRPGGG
NMKDNWRSELYKYKVVEVKPLGVAPTNARRRVVEREKRAVGMGAVPLGFLGAAGSTMGAASITLTVQARQLLSGIVQ
QQSNLLKAIEAQQHMLKLTVWGIKQLQARVLALERYLKDQQLLGMWGCSGKLICTTNVYWNSSWSNKTYGDIWDNMT
WMQWEREISNYTEIIYELLEESQNQQEKNEQDLLALDRWNSLWNWFNITNWLWYIKIFIMIVGGLIGLRIIFAVLSL
VNRVRQGYSPLSLQTLIPSPRGPDRPGGIEEEGGEQDRNRSTRLVSGFLALVWDDLRSLCLFIYHRLRDFILIAARA
GELLGRSSLKGLRRGWEALKYLGSLVQYWGLELKRSAISLLDTLAITVGEGTDRILEFVLGICRAIRNIPTRIRQGF
ETALL*
>703010505.w30.8
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATTNATASNSSIIEGMKNCSFNITT
ELRDKREKKNALFYKLDIVQLDGNSSQYRLINCNTSVITQACPKVSFDPIPIHYCAPAGYAILKCNNKTFTGTGPCN
NVSTVQCTHGIKPVVSTQLLLNGSLAEGEIIIRSENITNNAKTIIVHLNESVKIECTRPSNKTRTSIRIGPGQAFYA
TGQVIGDIREAYCNISESKWNETLQRVSKKLKEYFPHKNITFQPSSGGDLEITTHSFNCGGEFFYCNTSSLFNRTYM
ANSTDMANSTETNSTRTITIRCRIKQIINMWQEVGRAMYAPPIAGNITCISNITGLLLTRDGGKNNTDTETFRPGGG
NMKDNWRSELYKYKVVEVKPLGVAPTNARRRVVEREKRAVGMGAVPLGFLGAAGSTMGAASITLTVQARQLLSGIVQ
QQSNLLKAIEAQQHMLKLTVWGIKQLQARVLALERYLKDQQLLGMWGCSGKLICTTNVYWNSSWSNKTYGDIWDNMT
WMQWEREISNYTEIIYELLEESQNQQEKNEQDLLALDRWNSLWNWFNITNWLWYIKIFIMIVGGLIGLRIIFAVLSL
VNRVRQGYSPLSLQTLIPSPRGPDRPGGIEEEGGEQDRNRSTRLVSGFLALVWDDLRSLCLFIYHRLRDFILIAARA
GELLGRSSLKGLRRGWEALKYLGSLVQYWGLELKRSAISLLDTLAITVGEGTDRILEFVLGICRAIRNIPTRIRQGF
ETALL*
>703010505.w30.25
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATTNATASNSSIIEGMKNCSFNITT
ELRDKREKKNALFYKLDIVQLDGNSSQYRLINCNTSVITQACPKVSFDPIPIHYCAPAGYAILKCNNKTFTGTGPCN
NVSTVQCTHGIKPVVSTQLLLNGSLAEGEIIIRSENITNNAKTIIVHLNESVKIECTRPNNKTRTSIRIGPGQAFYA
TGQVIGDIREAHCNISESKWNETLQRVSKKLKEYFPHKNITFQPSSGGDLEITTHSFNCGGEFFYCNTSSLFNRTYM
ANSTDMANSTETNSTRTITIRCRIKQIINMWQEVGRAMYAPPIAGNITCISNITGLLLTRDGGKNNTDTETFRPGGG
NMKDNWRSELYKYKVVEVKPLGVAPTNARRRVVEREKRAVGMGAVPLGFLGAAGSTMGAASITLTVQARQLLSGIVQ
QQSNLLKAIEAQQHMLKLTVWGIKQLQARVLALERYLKDQQLLGMWGCSGKLICTTNVYWNSSWSNKTYGDIWDNMT
WMQWEREISNYTEIIYELLEESQNQQEKNEQDLLALDRWNSLWNWFNITNWLWYIKIFIMIVGGLIGLRIIFAVLSL
VNRVRQGYSPLSLQTLIPSPRGPDRPGGIEEEGGEQDRNRSTRLVSGFLALVWDDLRSLCLFIYHRLRDFILIAARA
GELLGRSSLKGLRRGWEALKYLGSLVQYWGLELKRSAISLLDTLAIAVGEGTDRILEFVLGICRAIRNIPTRIRQGF
ETALL*
>703010505.w30.21
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATTNATASNSSIIEEMKNCSFNITT
ELRDKREKKNALFYKLDIVQLDGNSSQYRLINCNTSVITQACPKVSFDPIPIHYCAPAGYAILKCNNKTFTGTGPCN
NVSTVQCTHGIKPVVSTQLLLNGSLAEGEIIIRSENITNTAKTIIVHLNESVKIECTRPNNKTRTSIRIGPGQAFYA
TGQVIGDIREAYCNISESKWNETLQRVSKKLKEYFPHKNITFQPSSGGDLEITTHSFNCGGEFFYCNTSSLFNRTYM
ANSTDMANSTETNSTRTITIRCRIKQIINMWQEVGRAMYAPPIAGNITCISNITGLLLTRDGGENNTETFRPGGGNM
KDNWRSELYKYKVVEVKPLGVAPTNARRRVVEREKRAVGMGAVFLGFLGAAGSTMGAASITLTVQARQLLSGIVQQQ
SNLLKAIEAQQHMLKLTVWGIKQLQARVLALERYLKDQQLLGMWGCSGKLICTTNVYWNSSWSNKTYGDIWDNMTWM
QWEREISNYTEIIYELLEESQNQQEKNEQDLLALDRWNSLWNWFNITNWLWYIKIFIMIVGGLIGLRIIFAVLSLVN
RVRQGYSPLSLQTLIPSPRGPDRPGGIEEEGGEQDRNRSTRLVSGFLALVWDDLRSLCLFIYHRLRDFILIAARAGE
LLGRSSLKGLRRGWEALKYLGSLVQYWGLELKRSAISLLDTLAIAVGEGTDRILEFVLGICRAIRNIPTRIRQGFET
ALL*
>703010505.w30.18
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATANATASNSSIIEGMKNCSFNITT
ELRDKREKKNALFYKLDIVQLDGNSSQYRLINCNTSVITQACPKVSFDPIPIHYCAPAGYAILKCNNKTFTGTGPCN
NVSTVQCTHGIKPVVSTQLLLNGSLAEGEIIIRSENITNNAKTIIVHLNESVKIECTRPNNKTETSIRIGPGQAFYA
TGQVIGDIREAYCNISESKWNETLQRVSKKLKEYFPHKNITFQPSSGGDLEITTHSFNCGGEFFYCNTSSLFNRTYM
ANSTDMANSTETNSTRIITIHCRIKQIINMWQEVGRAMYAPPIAGNITCISNITGLLLTRDGGKNNPETFRPGGGNM
KDNWRSELYKYKVVEVKPLGVAPTNARRRVVEREKRAVGLGAVFLGFLGAAGSTMGAASITLTVQARQLLSGIVQQQ
```

FIG. 17A cont'd

SNLLKAIEAQQHMLKLTVWGIKQLQARVLALERYLKDQQLLGMWGCSGKLICTTNVYWNSSWSNKTYGDIWDNMTWM
QWEREISNYTEIIYELLEESQNQQEKNEQDLLALDRWNSLWNWFNITNWLWYIKIFIMIVGGLIGLRIIFAVLSLVN
RVRQGYSPLSLQTLIPSPRGPDRPGGIEEEGGEQDRNRSTRLVSGFLALVWDDLRSLCLFIYHRLRDFILIAARAGE
LLGRSSLKGLRRGWEALKYLGSLVQYWGLELKRSAISLLDTLAIVVGEGTDRILEFVLGICRAIRNIPTRIRQGFET
ALL*
>703010505.w30.24
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATANATASNSSIIEGMKNCSFNITT
ELRDKREKKNALFYKLDIVQLDGNSSQYRLINCNTSVITQACPKVSFDPIPIHYCAPAGYAILKCNNKTFNGTGPCN
NVSTVQCTHGIKPVVSTQLLLNGSLAEGEIIIRSENITNNVKTIIVHLNESVKIECTRPNNKTRTSIRIGPGQAFYA
TGQVIGDIREAXCNISESKWNETLQRVSKKLKEYFPHKNITFQPSSGGDLEITTHSFNCGGEFFYCNTSSLFNRTYM
ANSTDMANSTETNSTRTIKKHCRIKQIINMWQEVGRAMYAPPIAGNITCISNITGLLLTREGGKNNTETFRPGGGNM
KDNWRSELYKYKVVEVKPLGVAPTNARRRVVEREKRAVGMGAVFLGFLGAAGSTMGAASITLTVQARQLLSGIVQQQ
SNLLKAIEAQQHMLKLTVWGIKQLQARVLALERYLKDQQLLGMWGCSGKLICTTNVYWNSSWSNKTYGDIWDNMTWM
QWEREISNYTEIIYELLEESQNQQEKNEQDLLALDRWNSLWNWFNITNWLWYIKIFIMIVGGLIGLRTIFAVLSLVN
RVRQGYSPLSLQTLIPSPRGPDRPGGIEEEGGEQDRNRSTRLVSGFLALVWDDLRSLCLFIYHRLRDFILIAARAGE
LLGRSSLKGLRRGWEALKYLGSLVQYWGLELKRSAISLLDTLAIAVGEGTDRILEFVLGICRAIRNIPTRIRQGFET
ALL*
>703010505.w30.9
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATANATASNSSIIEGMKNCSFNITT
ELRDKREKKNALFYKLDIVQLDGNSSQYRLINCNTSVITQACPKVSFDPIPIHYCAPAGYAILKCNNKTFNGTGPCN
NVSTVQCTHGIKPVVSTQLLLNGSLAEGEIIIRSENITNNVKTIIVHLNESVKIECTRPNNKTRTSIRIGPGQAFYA
TGQVIGDIREAHCNISESKWNKTLQRVSKKLKEYFPHKNITFQPSSGGDLEITTHSFNCGGEFFYCNTSSLFNRTYM
ANSTDMANSTETNSTRTITIRCRIKQIINMWQEVGRAMYAPPIAGNITCISNITGLLLTREGGKNNTDTETFRPGGG
NMKDNWRSELYKYKVVEVKPLGVAPTNARRRVVEREKRAVGMGAVFLGFLGAAGSTMGAASITLTVQARQLLSGIVQ
QQSNLLKAIEAQQHMLKLTVWGIKQLQARVLALERYLKDQQLLGMWGCSGKLICTTNVYWNSSWSNKTYGDIWDNMT
WMQWEREISNYTEIIYELLEESQNQQEKNEQDLLALDRWNSLWNWLNITNWLWYIKIFIMIVGGLIGLRIIFAVLSL
VNRVRQGYSPLSLQTLIPSPRGPDRPGGIEEEGGEQDRNRSTRLVSGFLALVWDDLRSLCLFIYHRLRDFILIAARA
GELLGRSSLKGLRRRWEALKYLGSLVQYWGLELKRSAISLLDTLATAIGEGTDRILEFVLGICRAIRNIPTRIRQGF
ETALL*
>703010505.w30.36
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATANATASNSSIIEGMKNCSFNITT
ELRDKREKKNALFYKLDIVQLDGNSSQYRLINCNTSVITQACPKVSFDPIPIHYCAPAGYAILKCNNKTFNGTGPCN
NVSTVQCTHGIKPVVSTQLLLNGSLAEGEIIIRSENITNNVKTIIVHLNESVKIECTRPNNKTRTSIRIGPGQAFYA
TGQVIGDIREAYCNISESKWNETLQRVSKKLKEYFPHKNITFQPSSGGDLEITTHSFNCGGEFFYCNTSSLFNRTYM
ANSTDMANSTETNSTRTIKIHCRIKQIINMWQEVGRAMYAPPIAGNITCISNITGLLLTREGGKNNTDTETFRPGGG
NMKDNWRSELYKYKVVEVKPLGVAPTNARRRVVEREKRAVGMGAVFLGFLGAAGSTMGAASITLTVQARQLLSGIVQ
QQSNLLKAIEAQQHMLKLTVWGIKQLQARVLALERYLKDQQLLGMWGCSGKLICTTNVYWNSSWSNKTYGDIWDNMT
WMQWEREISNYTEIIYELLEESQNQQEKNEQDLLALDRWNSLWNWLNITNWLWYIKIFIMIVGGLIGLRIIFAVLSL
VNRVRQGYSPLSLQTLIPSPRGPDRPGGIEEEGGEQDRNRSTRLVSGFLALVWDDLRSLCLFIYHRLRDFILIAARA
GELLGRSSLKGLRRGWEALKYLGSLVQYWGLELKRSAISLLDTLATAVGEGTDRILEFVLGICRAIRNIPTRIRQGF
ETALL*
>703010505.w30.5
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATANATASNSSIIEGMKNCSFNITT
ELRDKREKKNALFYKLDIVQLDGNSSQYRLINCNTSVITQACPKVSFDPIPIHYCAPAGYAILKCNNKTFTGTGPCN
NVSTVQCTHGIKPVVSTQLLLNGSLAEGEIIIRSENITNNGKTIIVQLNESVKIECTRPNNKTRTSIRIGPGQAFYA
TGQVIGNIREAYCNISESKWNETLQRVSKKLKEYFPHKNITFQPSSGGDLEITTHSFNCGGEFFYCNTSSLFNRTYM
ANSTDMANSTETNSTRIITIHCRIKQIINMWQEVGRAMYAPPIAGNITCISNITGLLLTREGGKNNTDTETFRPGGG
NMKDNWRSELYKYKVVEVKPLGVAPTNARRRVVEREKRAVGMGAVFLGFLGAAGSTMGAASITLTVQARQLLSGIVQ
QQSNLLKAIEAQQHMLKLTVWGIKQLQARVLALERYLKDQQLLGMWGCSGKLICTTNVYWNSSWSNKTYGDIWDNMT
WMQWEREISNYTEIIYELLEESQNQQEKNEQDLLALDRWNSLWNWFNITNWLWYIKIFIMIVGGLIGLRIIFAVLSL
VNRVRQGYSPLSLQTLIPSPRGPDRPGGIEEEGGEQDRNRSTRLVSGFLALVWDDLRSLCLFIYHRLRDFILIAARA
GELLGRSSLKGLRRGWEALKYLGSLVQYWGLELKRSAISLLDTLAIAVGEGTDRILEFVLGICRAIRNIPTRIRQGF
ETALL*
>703010505.w30.37
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNATASNSSIIEGMKNCSFNIT
TELRDKREKKNALFYKLDIVQLDGNSSQYRLINCNTSVITQACPKVSFDPIPIHYCAPAGYAILKCNNKTFTGTGPC
NNVSTVQCTHGIKPVVSTQLLLNGSLAEGEIIIRSENITNNVKTIIVELNESVKIECTRPNNKTRTSIRIGPGQAFY
ATGQVIGNIREAYCNISESKWNETLQRVSKKLKEYFPHKNITFQPSSGGDLEITTHSFNCGGEFFYCNTSSLFNRTY
MANSTDMANSTETNSTRIITIHCRIKQIINMWQEVGRAMYAPPIAGNITCISNITGLLLTRDGGKNNTDTETFRPGG
GNMKDNWRSELYKYKVVEVKPLGVAPTNARRRVVEREKRAVGMGAVFLGFLGAAGSTMGAASITLTVQARQLLSGIV
QQQSNLLKAIEAQQHMLKLTVWGIKQLQARVLALERYLKDQQLLGMWGCSGKLICTTNVYWNSSWSNKTYGDIWDNM
TWMQWEREISNYTEIIYELLEESQNQQEKNEQDLLALDRWNSLWNWFNITNWLWYIKIFIMIVGGLIGLRIIFAVLS
LVNRVRQGYSPLSLQTLIPSPRGPDRPGGIEEEGGEQDRNRSTRLVSGFLALVWDDLRSLCLFIYHRLRDFILIAAR
AGELLGRSSLKGLRRGWEALKYLGSLVQYWGLELKRSAISLLDTLAIAVGEGTDRILEFVLGICRAIRNIPTRIRQG
FETALL*

FIG. 17A cont'd

>703010505.w30.27
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNATASNSSIIEGMKNCSFNIT
TELRDKREKKNALFYKLDIVQLDGNSSQYRLINCNTSVITQACPKVSFDPIPIHYCAPAGYAILKCNNKTFTGTGPC
NNVSTVQCTHGIKPVVSTQLLLNGSLAEGEIIIRSENITNNVKTIIVHLNESVKIECTRPNNKTRTSIRIGPGQAFY
ATGQVIGNIREAYCNISESKWNETLQRVSKKLKEYFPHKNITFQPSSGGDLEITTHSFNCGGEFFYCNTSSLFNRTY
MANSTDMANSTETNSTRIITIHCRIKQIINMWQEVGRAMYAPPIAGNITCISNITGLLLTRDGGKNNTDTETFRPGG
GNMKDNWRSELYKYKVVEVKPLGVAPTNARRRVVEREKRAVGMGAVFLGFLGAAGSTMGAASITLTVQARQLLSGIV
QQQSNLLKAIEAQQHMLKLTVWGIKQLQARVLALERYLKDQQLLGMWGCSGKLICTTNVYWNSSWSNKTYGDIWDNM
TWMQWEREISNYTEIIYELLEESQNQQEKNEQDLLALDRWNSLWNWFNITNWLWYIKIFIMIVGGLIGLRIIFAVLS
LVNRVRQGYSPLSLQTLIPSPRGPDRPGGIEEEGGEQDRNRSTRLVSGFLALVWDDLRSLCLFIYHRLRDFILIAAR
AGELLGRSSLKGLRRGWEALKYLGSLVQYWGLELKRSAISLLDTLAIAVGEGTDRILEFVLGICRAIRNIPTRIRQG
FETALL*
>703010505.w30.34
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNATASNSSIIEGMKNCSFNIT
TELRDKREKKNALFYKLDIVQLDGNSSQYRLINCNTSVITQACPKVSFDPIPIHYCAPAGYAILKCNNKTFTGTGPC
NNVSTVQCTHGIKPVVSTQLLLNGSLAEGEIIIRSENITNNVKTIIVHLNESVKIECTRPNNKTRTSIRIGPGQAFY
ATGQVIGNIREAYCNISESKWNETLQRVSKKLKEYFPHKNITFQPSSGGDLEITTHSFNCGGEFFYCNTSSLFNRTY
MANSTDMANSTETNSTRTITIPCRIKQIINMWQEVGRAMYAPPIAGNITCISNITGLLLTRDGGKNNTDTETFRPGG
GNMKDNWRSELYKYKVVEVKPLGVAPTNARRRVVEREKRAVGMGAVFLGFLGAAGSTMGAASITLTVQARQLLSGIV
QQQSNLLKAIEAQQHMLKLTVWGIKQLQARVLALERYLKDQQLLGMWGCSGKLICTTNVYWNSSWSNKTYGDIWDNM
TWMQWEREISNYTEIIYELLEESQNQQEKNEQDLLALDRWNSLWNWFNITNWLWYIKIFIMIVGGLIGLRIIFAVLS
LVNRVRQGYSPLSLQTLIPSPRGPDRPGGIEEEGGEQDRNRSTRLVSGFLALVWDDLRSLCLFIYHRLRDFILIAAR
AGELLGRSSLKGLRRGWEALKYLGSLVQYWGLELKRSAISLLDTLAIAVGEGTDRILEFVLGICRAIRNIPTRIRQG
FETALL*
>703010505.w30.23
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNATASNSSIIEGMKNCSFNIT
TELRDKREKKNALFYKLDIVQLDGNSSQYRLINCNTSVITQACPKVSFDPIPIHYCAPAGYAILKCNNKTFTGTGPC
NNVSTVQCTHGIKPVVSTQLLLNGSLAEGEIIIRSENITNNGKTIIVHLNESVKIECTRPSNKTRTSIRIGPGQAFY
ATGQVIGDIREAHCNISESKWNETLQRVSKKLKEYFPHKNITFQPSSGGDLEITTHSFNCGGEFFYCNTSSLFNETY
MANSTDMANSTETNSTRTITILHCRIKQIINMWQEVGRAMYAPPIAGNITCISNITGLLLTRDGGKNNTDTETFRPGG
GNMKDNWRSELYKYKVVEVKPLGVAPTNARRRVVEREKRAVGMGAVFLGFLGAAGSTMGAASITLTVQARQLLSGIV
QQQSNLLKAIEAQQHMLKLTVWGIKQLQARVLALERYLKDQQLLGMWGCSGKLICTTNVYWNSSWSNKTYGDIWDNM
TWMQWEREISNYTEIIYELLEESQNQQEKNEQDLLALDRWNSLWNWFNITNWLWYIKIFIMIVGGLIGLRIIFAVLS
LVNRVRQGYSPLSLQTLIPSPRGPDRPGGIEEEGGEQDRNRSTRLVSGFLALVWDDLRSLCLFIYHRLRDFILIAAR
AGELLGRSSLKGLRRGWEALKYLGSLVQYWGLELKRSAISLLDTLAIAVGEGTDRILEFVLGICRAIRNIPTRIRQG
FETALL*
>703010505.w30.16
MRVMGIQRNYPQWWIWSMLGFWMLMICNGMWVTVYYGVPVWKEAKTTLFCASDAKAYEKEVHNVWATHACVPTDPNP
QEMGLKNVTENFNMWKNDMVDQMHEDVISLWDQSLKPCVKLTPLCVTLNCTNATASNATASNSSIIEGMKNCSFNIT
TELRDKREKKNALFYKLDIVQLDGNSSQYRLINCNTSVITQACPKVSFDPIPIHYCAPAGYAILKCNNKTFTGTGPC
NNVSTVQCTHGIKPVVSTQLLLNGSLAEGEIIIRSENITNNGKTIIVHLNESVKIECTRPNNKTRTSIRIGPGQAFY
ATGQVIGDIREAHCNISESKWNETLQRVSKKLKEYFPHQNITFQPSSGGDLEITTHSFNCGGEFFYCNTSSLFNRTY
MANSTDMANSTETNSTRTITIRCRIKQIINMWQEVGRAMYAPPIAGNITCISNITGLLLTRDGGKNNTDTETFRPGG
GNMKDNWKSELYKYKVVEVKPLGVAPTNARRRVVEREKRAVGMGAVFLGFLGAAGSTMGAASITLTVQARQLLSGIV
QQQSNLLKAIEAQQHMLKLTVWGIKQLQARVLALERYLKDQQLLGMWGCSGKLICTTNVYWNSSWSNKTYGDIWDNM
TWMQWEREISNYTEIIYELLEESQNQQEKNEQDLLALDRWNSLWNWFNITNWLWYIKIFIMIVGGLIGLRIIFAVLS
LVNRVRQGYSPLSLQTLIPSPRGPDRPGGIEEEGGEQDRNRSTRLVSGFLALVWDDLRSLCLFIYHRLRDFILIAR
AGELLGRSSLKGLRRGWEALKYLGSLVQYWGLELKRSAISLLDTLAIAVGEGTDRILEFVLGICRAIRNIPTRIRQG
FETALL*
>703010505.w30.30
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNATASNSSIIKGMKNCSFNIT
TELRDKREKKNALFYKLDIVQLDGNSSQYRLINCNTSVITQACPKVSFDPIPIHYCAPAGYAILKCNNKTFTGTGPC
NNVSTVQCTHGIKPVVSTQLLLNGSLAEGEIIIRSENITNNGKTIIVHLNESVKIECTRPNNKTRTSIRIGPGQAFY
ATGQVIGDIREAHCNISESKWNETLQRVSKKLKEYFPHKNITFQPSSGGDLEITTHSFNCGGEFFYCNTSSLFNRTY
MANSTDMANSTETNSTRTITIRCRIKQIINMWQEVGRAMYAPPIAGNITCISNITGLLLTRDGGKNNTDTETFRPGE
GNMKDN*RSKLYKYKVVEVKPLGVAPTNARRRVVEREKRAVGMGAVFLGFLGAAGSTMGAASITLTVQARQLLSGIV
QQQSNLLKAIEAQQHMLKLTVWGIKQLQARVLALERYLKDQQLLGMWGCSGKLICTTNVYWNSSWSNKTYGDIWDNM
TWMQWEREISNYTEIIYKLLEESQNQQEKNEQDLLALDRWNSLWNWFNITNWLWYIKIFIMIVGGLIGLKIIFAVLS
LVNRVRQGYSPLSLQTLIPSPRGPDRPGGIEEEGGEQDRNRSTRLVSGFLALVWDDLRSLCLFIYHRLRDFILIAAR
AGELLGRSSLKGLRRGWEALKYLGSLVQYWGLELKRSAISLLDTLAIAVGEGTDRILKFVLGICRAIRNIPTRIRQG
FETALL*
>703010505.w30.33
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATTSNSSTSNSSIIEGMKNCSFNIT
TELRDKREKKNALFYKLDIVQLDGNSSQYRLINCNTSVITQACPKVSFDPIPIHYCAPAGYAILKCNNKTFTGTGPC
NNVSTVQCTHGIKPVVSTQLLLNGSLAEGEIIIRSENITNNVKTIIVHLNESVKIECTRPSNKTRTSIRIGPGQAFY

FIG. 17A cont'd

ATGQVIGDIREAYCNISESKWNETLQRVSKKLKEYFPHKNITFQPSSGGDLEITTHSFNCGGEFFYCNTSSLFNRTY
MANSTDMANSTETNSTRTITIRCRIKQIINMWQEVGRAMYAPPIAGNITCISNITGLLLTRDGGKNNTDTETFRPGG
GNMKDNWRSELYKYKVVEVKPLGVAPTNARRRVVEREKRAVGMGAVFLGFLGAAGSTMGAASITLTVQARQLLSGIV
QQQSNLLKAIEAQQHMLKLTVWGIKQLQARVLALERYLKDQQLLGMWGCSGKLICTTNVYWNSSWSNKTYGDIWDNM
TWMQWEREISNYTEIIYELLEESQNQQEKNEQDLLALDRWNSLWNWFNITNWLWYIKIFIMIVGGLIGLRIIFAVLS
LVNRVRQGYSPLSLQTLIPSPRGPDRFGGIEEEGGEQDRNRSTRLVSGFLALVWDDLRSLCLFIYHRLRDFILIAAR
AGELLGRSSLKGLRRGWEALKYLGSLVQYWGLELKRSAISLLDTLAIAVGEGTDRILKFVLGICRAIRNIPTRIRQG
FETALL*
>703010505.w30.26
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNAPSNSSIIEEMKNCSPNITTELRDK
REKKNALFYKLDIVQLDGNSSQYRLINCNTSVITQACPKVSFDPIPIHYCAPAGYAILKCNNKTFTGTGPCNNVSTV
QCTHGIKPVVSTQLLLNGSLAEGEIIIRSENITNNGKTIIVHLNESVKIECTRPNNNTRTSIRIGPGQAFYATGQVI
GDIREAYCNISESKWNETLQRVSKKLKEYFPHKNITFQPSSGGDLEITTHSFNCGGEFFYCNTSSLFNRTYMANSTD
MANSTETNSTETITIRCRIKQIINMWQEVGRAMYAPPIAGNITCISNITGLLLTRDGGKNNTDYETFRPGGGNMKDN
WRSELYKYKVVEVKPLGVAPTNARRRVVEREKRAVGMGAVFLGFLGAAGSTMGAASITLTVQARQLLSGIVQQQSNL
LKAIEAQQHMLKLTVWGIKQLQARVLALERYLKDQQLLGMWGCSGKLICTTNVYWNSSWSNKTYGDIWDNMTWMQWE
REISNYTEIIYELLEESQNQQEKNEQDLLALDRWNSLWNWFNITNWLWYIKIFIMIVGGLIGLRIIFAVLSLVNRVR
QGYSPLSLQTLIPSPRGPDRPGGIEEEGGEQDRNRSTRLVSGFLALVWDDLRSLCLFIYHRLRDFILIAARAGELLG
RSSLKGLRRGWEALKYLGSLVQYWGLELKRSAISLLDTLAIAIGEGTDRILEFVLGICRAIRNIPTRIRQGFETALL
*
>703010505.w30.10
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATTSNSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNDKTIIVHLNESVKIECTRPNNNTRTSIRIGPGQAFYATGQV
IGDIREAYCNISESKWNETLQRVSKKLKEYFPHKNITFQPSSGGDLEITTHSFNCGGEFFYCNTSSLFNRTYMANST
DMANSTETNSTRIITIRCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w30.28
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKMTPLCVTLNCTNATAINSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNMDKTIIVHLNESVKIECTRPNNNKTRTSIRIGPGQAFYATGQV
IGDIREAHCNISESKWNETLQRVSKKLKEYFPHKNITFQPSSGGDLEITTHSFNCGGEFFYCNTSSLFNRTYMANST
DMANSTETNSTRTITIRCRIKQIINMWQEVGRAMYAPPIAGNITCISNITGLLLTRDGGKNNTETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKSYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w30.15
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKMTPLCVTLNCTNATAINSSIIEGMKNCSFNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITNNDKTIIVHLNESVKIECTRPNNKTRTSIRIGPGQAFYATGQV
IGDIREAYCNISESKWNETLQRVSKKLKEYFPHKNITFQPSSGGDLEITTHSFNCGGEFFYCNTSSLFNRTYMANST
DMANSTETNNTRPITIHCRIKQIINMWQEVGRAMYAPPIAGNITCISNITGLLLTRDGGKNNTEIFRPGGGNMKDNW
RSELYKYKVVEVKPLGTAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALVWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w30.19
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATASNSSIIEGMKNCSF
NITTELRDKREKKNALFYKLDIVQLDGNSSQYRLINCNTSVITQACPKVSFDPIPIHYCAPAGYAILKCNNKTFTGT
GPCNNVSTVQCTHGIKPVVSTQLLLNGSLAEGEIIIRSENITNSGKTIIVHLNESVKIECTRPNNKTRTSIRIGPGQ
AFYATGQVIGDIREAYCNISESKWNETLQRVSKKLKEYFPHKNITFQPSSGGDLEITTHSFNCGGEFFYCNTSSLFN
RTYMANSTDMANSTETNSTRITTIHCRIKQIINMWQEVGRAMYAPPIAGNITCISSITGLLLTRDGGENNTETFRPG
GGNMKDNWRSELYKYKVVEVKPLGVAPTNARRRVVEREKRAVGMGAVFLGFLGAAGSTMGAASITLTVQARQLLSGI
VQQQSNLLKAIEAQQHMLKLTVWGIKQLQARVLALERYLKDQQLLGMWGCSGKLICTTNVYWNSSWSNKTYGDIWDN
MTWMQWEREISNYTEIIYELLEESQNQQEKNEQDLLALDRWNSLWNWFNITNWLWYIKIFIMIVGGLIGLRIIFAVF
SLVNRVRQGYSPLSLQTLIPSPRGPDRPGGIEEEGGEQDRNRSTRLVSGFLALVWDDLRSLCLFIYHRLRDFILIAA
RAGELLGRSSLKGLRRGWEALKYLGSLVQYWGLELKRSAISLLDTLAIAVGEGTDRILEFVLGICRAIRNIPTRIRQ
GFETALL*

FIG. 17A cont'd

>703010505.w30.32
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTATASNSSINCTNATASNSSIIEGMK
NCSFNITTELRDKREKKNALFYKLDIVQLDGNSSQYRLINCNTSVITQACPKVSFDPIPIHYCAPAGYAILKCNNKT
FTGTGPCNNVSTVQCTHGIKPVVSTQLLLNGSLAEGEIIIRSENITNGKTIIVHLNESVKIECTRPNNKTRTSIRI
GPGQAFYATGQVIGDIREAYCNISESKWNETLQRVSKKLKEYFPHKNITFQPSSGGDLEITTHSFNCGGEFFYCNTS
SLFNRTYMANSTDMANSTETNSTRTITIRCRIKQIINMWQEVGRAMYAPPIAGNITCISNITGLLLTRDGGKNDTET
FRPGGGNMKDNWRSELYKYKVVEVKPLGVAPTNARERRVVEREKRAVGMGAVFLGFLGAAGSTMGAASITLTVQARQL
LSGIVQQQSNLLKAIEAQQHMLKLTVWGIKQLQARVLALERYLKDQQLLGMWGCSGKLICTTNVYWNSSWSNKTYGD
IWDNMTWMQWEREISNYTEIIYELLEESQNQQEKNEQDLLALDRWNSLWNWFNITNWLWYIKIFIMIVGGLIGLRII
FAVLSLVNRVRQGYSPLSLQTLIPSPRGPDRPGGIEEEGGEKDRNRSTRLVSGFLALVWDDLRSLCLFIYHRLRDFI
LIAARAGELLGRSSLKGLRRGWEALKYLGSLVQYWGLELKRSAISLLDTLAIAVGEGTDRILEFVLGICRAIRNIPT
RIRQGFETALL*
>703010505.w30.14
MRVMGIQRNYPQWWIWSMLGFWMLMICKGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTATASNISIIEEMKNCSPNITTELRD
KREKKNALFYKLDIVQLDGNSSQYRLINCNTSVITQACPKVSFDPIPIHYCAPAGYAILKCNNKTFTGTGPCNNVST
VQCTHGIKPVVSTQLLLNGSLAEGEIIIRSENITDNVKTIIVHLNESVKIECTRPNHKTRTSIRIGPGQAFYATGQV
IGDIREAYCNISESKWNETLQRVSKKLKEYFPHKNITFQPSSGGDLEITTHSFNCGGEFFYCNTSSLFNRTYMANST
DMANSTETNSTRTITIRCRIKQIINMWQEVGRAMYAPPIAGNITCISNITGLLLTRDGGKNNTDTETFRPGGGNMKD
NWRSELYKYKVVEVKPLGVAPTNARRRVVEREKRAVGMGAVFLGFLGAAGSTMGAASITLTVQARQLLSGIVQQQ#K
QLQARVLALERYLKDQQLLGMWGCSGKLICTTNVYWNSSWSNKTYGDIWDNMTWMQWEREISNYTEIIYELLEESQN
QQEKNEQDLLALDRWNSLWNWFNITNWLWYIKIFIMIVGGLIGLRIIFAVLSLVNRVRQGYSPLSLQTLIPSPRGPD
RPGGIEEEGGEQDRNRSTRLVSGFLALVWDDLRSLCLFIYHRLRDFILIAARAGELLGRSSLKGLRRGWEALKYLGS
LVQYWGLELKRSAISLLDTLAIAIGEGTDRILEFVLGICRAIRNIPTRIRQGFETALL*
>703010505.w53.15
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTATNATASNSSILEGMKNCSFNITTE
LRDKREKKNALFYKLDIVQLDGNSSQYRLINCNTSVITQACPKVSFDPIPIHYCAPAGYAILKCNNKTFNGTGPCNN
VSTVQCTEGIKPVVSTQLLLNGSLAEGEIIIRSENITDNGKTIIVHLNESVKIECTRPSNNTRTSIRIGPGQAFYAT
GQVIGDIREAHCNISESKWNETLQRVSKKLKEYFPHKNITFQPSSGGDLEITTHSFNCGGEFFYCNTSSLFNRTYMA
NSTETNSTRTITLHCRIKQIINMWQEVGRAMYAPPIAGNITCISNITGLLLTRDGGKNNTETFETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNESTRLVSGFLALAWDDLRSLCLFIYHRLRDFILIAAFAGELLGR
SSLKGLRRGWEALKYLGSLVQYWGLELKRSAISLLDTLAIAVGEGTDRILEFVLGICRAIRNIPTRIRQGFETALL*
>703010505.w53.27
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTATNATASNSSILEGMKNCSFNITTE
LRDKREKKNALFYKLDIVQLDGNSSQYRLINCNTSVITQACPKVSFDPIPIHYCAPAGYAILKCNNKTFNGTGPCNN
VSTVQCTEGIKPVVSTQLLLNGSLAEGEIIIRSENITDNGKTIIVHLNESVKIECTRPSNNTRTSIRIGPGQAFYAT
GQVIGDIREAHCNISESKWNETLQRVSKKLKEYFPEKNITFQPSSGGDLEITTHSFNCGGEFFYCNTSSLFNRTYMA
NSTETNSTRTITLHCRIKQIINMWQEVGRAMYAPPIAGNITCISNITGLLLTRDGGKNNTETFETFRPGGNMKDNW
RSELYKYKVVEVKPLGVAPTNARRRVVEREKRAVGMGAVFLGFLGAAGSTMGAASITLTVQARQLLSGIVQQQSNLL
KAIEAQQEMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVEQ
GYSPLSLQTLIPSPRGPDRPGGIEEEGGEQDRNRSTRLVSGFLALAWDDLRSLCLFIYHRLRDFILIAARAGELLGR
SSLKGLRRGWEALKCLGSLVQYWGLELKRSAISLLDTLAIAVGEGTDRILEFVLGICRAIRNIPTRIRQGFETALL*
>703010505.w53.3
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTATNATASNSSILEGMKNCSFNITTE
LRDKREKKNALFYKLDIVQLDGNSSQYRLINCNTSVITQACPKVSFDPIPIHYCAPAGYAILKCNNKTFNGTGPCNN
VSTVQCTEGIKPVVSTQLLLNGSLAEGEIIIRSENITDNGKTIIVHLNESVKIECTRPSNNTRTSIRIGPGQAFYAT
GQVIGDIREAHCNISESKWNETLQRVSKKLKEYFPEKNITFQPSSGGDLEITTHSFNCGGEFFYCNTSSLFNRTYMA
NSTETNSTRTITLHCRIKQIINMWQEVGRAMYAPPIAGNITCISNITGLLLTRDGGKNNTETFETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQDRNRSTRLVSGFLALAWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w53.17
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTATNATASNSSILEGMKNCSFNITTE
LRDKREKKNALFYKLDIVQLDGNSSQYRLINCNTSVITQACPKVSFDPIPIHYCAPAGYAILKCNNKTFNGTGPCNN
VSTVQCTEGIKPVVSTQLLLNGSLAEGEIIIRSENITDNGKTIIVHLNESVKIECTRPSNNTRTSIRIGPGQAFYAT
GQVIGDIREAHCNISESKWNETLQRVSKKLKEYFPEKNITFQPSSGGDLEITTHSFNCGGEFFYCNTSSLFNRTYMA
NSTETNSTRTITLHCRIKQIINMWQEVGRAMYAPPIAGNITCISNITGLLLTRDGGKNNTETFETFRPGGGNMKDNW
RSELYKYKVVEVKPLGVAPTNARRRVVEREKRAVGMGAVFLGFLGAAGSTMGAASITLTVQARQLLSGIVQQQSNLL
KAIEAQQHMLKLTVWGIKQLQARVLALERYLKDQQLLGMWGCSGKLICTTNVYWNSSWSNKTYGDIWDNMTWMQWER

FIG. 17A cont'd

```
EISNYTEIIYELLEESQNQQEKNEQDLLALDRWNSLWNWFNITNWLWYIKIFIMIVGGLIGLRIIFAVLSLVNRVRQ
GYSPLSLQTLIPSPRGPDRPGGIEEEGGEQXRNRSTRLVSGFLALAWDDLRSLCLFIYHRLRDFILIAARAGELLGR
SSLKGLRRGWEALKYLGSLVQYWGLELKRSAISLLDTLAIAVGEGTDRILEFVLGICRAIRNIPTRIRQGFETALL*
>703010505.w53.30
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTDATASNATAINISIIEEMKNCSFNIT
TELRDKREKKNALFYKLDIVQLDGNSSQYRLINCNTSVITQACPKVSFDPIPIHYCAPAGYAILKCNNKTFNGTGPC
NNVSTVQCTHGIKPVVSTQLLLNGSLAEGEIIIRSENITDNGKTIIVHLNESVKIECTRPNNNTRTSIRIGPGQAFY
ATGQVIGDIREAHCNISESKWNETLQRVSKKLKEYFPHKNITFQPSSGGDLEITTHSFNCGGEFFYCNTSSLFNRTY
MVNSTDMANSTETNSTRTITIRCRIKQIINMWQEVGRAMYAPPIAGNITCISNITGLLLTRDGGNNNTETFETFRPG
GGNMKDNWRSELYKYKVVEVKPLGVAPTNARRRVVEREKRAVGMGAVFLGFLGAAGSTMGAASITLTVQARQLLSGI
VQQQSNLLKAIEAQQHMLKLTVWGIKQLQARVLALERYLKDQQLLGMWGCSGKLICTTNVYWNSSWSNKTYGDIWDN
MTWMQWEREISNYTEIIYELLEESQNQQEKNEQDLLALDRWNSLWNWFNITNWLWYIKIFIMIVGGLIGLRIIFAVL
SLVNRVRQGYSPLSLQTLIPSPRGPDRPGGIEEEGGEQDRNRSTRLVSGFLALVWDDLRSLCLFIYHRLRDFILIAA
RAGELLGRSSLKGLRRGWEALKYLGSLVQYWGLELKRSAISLLDTLAIAVGEGTDRILEFVLGICRAIRNIPTRIRQ
GFETALL*
>703010505.w53.2
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTDATASNATASNATASNSSIIEGMKNC
SFNITTELRDKREKKNALFYKLDIVQLDGNSSQYRLINCNTSVITQACPKVSFDPIPIHMMANSTDTNSTRIITIRC
RIKQIINMWQEVGRAMYAPPIAGNITCISNITGLLLTRDGGKNNTETFETFRPGGGNMKDNWRSELYKYKVVEVKPL
GVAPTNARRRVVEREKRAVGMGAVFLGFLGAAGSTMGAASITLTVQARQLLSGIVQQQSNLLKAIEAQQHMLKLTVW
GIKQLQARVLALERYLKDQQLLGMWGCSGKLICTTNVYWNSSWSNKTYGDIWDNMTWMQWEREISNYTEIIYELLEE
SQNQQEKNEQDLLALDRWNSLWNWFNITNWL*YIKIFIMIVGGLIGLRIIFAVFSLVNRVRQGYSPLSLQTLIPSPR
GPDRPGGIEEEGGEQDRNRSTRLVSGFLALAWDDLRSLCLFIYHRLRDFILIAARAGELLGRSSLKGLRRGWEALKY
LGSLGQYWGLELKRSAISLLDTLAIAVGEGTDRILEFVLGICRAIRNIPTRIRQGFETALL*
>703010505.w53.10
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTDATASNATASNATASNSSIIEGMKNC
SFNITTELRDKREKKNALFYKLDIVQLDGNSSQYRLINCNTSVITQACPKVSFDPIPIHYCAPAGYAILKCNNKTFN
GTGPCNNVSTVQCTHGIKPVVSTQLLLNGSLAEGEIIIRSENITDNGKTIIVHLNESVKIECTRPSNNTRTSIRIGP
GQAFYATGQVIGDIREAHCNISESKWNETLQRVSKKLKEYFPHKNITFQPSSGGDLEITTHSFNCGGEFFYCNTSSL
FNRTYMANSTETNSTRIITIRCRIKQIINMWQEVGRAMYAPPIAGNITCISNITGLLLTRDGGKNNTETFETFRPGG
GNMKDNWRSELYKYKVVEVKPLGVAPTNARRRVVEREKRAVGMGAVFLGFLGAAGSTMGAASITLTVQARQLLSGIV
QQQSNLLKAIEAQQHMLKLTVWGIKQLQARVLALERYLKDQQLLGMWGCSGKLICTTNVYWNSSWSNKTYGDIWDNM
TWMQWEREISNYTETIYELLEESQNQQEKNEQDLLALDRWNSLWNWFNITNWLWYIKIFIMIVGGLIGLRIIFAVLS
LVNRVRQGYSPLSLQTLIPSPRGPDRPGGIEEEGGEQDRNRSTRLVSGFLALAWDDLRSLCLFIYHRLRDFILIAAR
AGELLGRSSLKGLPRGWEALKYLGSLVQYWGLELKRSAISLLDTLAIAVGEGTDRILEFVLGICRAIRNIPTRIRQG
FETALL*
>703010505.w53.29
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTDATASNATAINSSIIEGMKNCSFNIT
TELRDKREKKNALFYKLDIVQLDGNSSQYRLINCNTSVITQACPKVSFDPIPIRYCAPAGYAILKCNNKTFNGTGPC
NNVSTVQCTHGIKPVVSTQLLLNGSLAEGEIIIRSENITNNAKTIIVHLNESVKIECTRPSNNTRTSIRIGPGQAFY
ATGQVIGDIREAHCNISESKWNETLQRVSKKLKEYFPHKNITFQPSSGGDLEITTHSFNCGGEFFYCNTSSLFNRTY
MANSTETNSTRIITIRCRIKQIINMNQEVGRAMYAPPIAGNITCISNITGLLLTRDGGKNNTETFETFRPEGGNMKD
NWRSELYKYKVVEVKPLGVAPTNARRRVVEREKRAVGMGAVFLGPLGAAGSTMGAASITLTVQARQLLSGIVQQQSN
LLKAIEAQQHMLKIKQLQARVLALERYLKDQQLLGMWGCSGKLICTTNVYWNSSWSNKTYGDIWDNMTWMQW
EREISNYTEIIYELLEESQNQQEKNEQDLLALDRWNSLWNWFNITNWLWYIKIFIMIVGGLIGLRIIFAVLSLVNRV
RQGYSPLSLQTLIPSPRGPDRPGGIEEEGGEQDRNRSTRLVSGFLALAWDDLRSLCLFIYHRLRDFILIAARAGELL
GRSSLKGLRRGWEALKYLGSLVQYWGLELKRSAISLLDTLAIAVGEGTDRILEFVLGICRAIRNIPTRIRQGFETAL
L*
>703010505.w53.14
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTTANATASNSSIIEGMKNCSFNITTEL
RDKREKKNALFYKLDIVQLDGNSSQYRLINCNTSVITQACPKVSFDPIPIHYCAPAGYAILKCNNKTFNGTGPCNNV
STVQCTHGIKPVVSTQLLLNGSLAEGEIIIRSENITDNGKTIIVHLNESVKIECTRPSNNTRTSIRIGPGQAFYATG
QVIGDIREAHCNISESKWNETLQRVSKKLKEYFPHKNITFQPSSGGDLEITTHSFNCGGEFFYCNTSSLFNRTYMAT
STDMANSTETNSTRIITIRCRIKQIINMWQEVGRAMYAPPIAGNITCISNITGLLLTRDGGKNNTETFETFPGGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYGDIWDNMTW
MQWEREISNYTELIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAVRAG
ELLGRSSLKGLRRGWEALKYLGSLVQYWGLELKRSAISLLDTLAIAVGEGTDRILEFVLGICRAIRNIPTRIRQGFE
TALL*
>703010505.w53.6
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNATNATASNSSILEGMKNCSFNITTE
LRDKREKKNALFYKLDIVQLDGNSSQYRLINCNTSVITQACPKVSFDPIPIHYCAPAGYAILKCNNKTFNGTGPCNN
VSTVQCTHGIKPVVSTQLLLNGSLAEGEIIIRSENITDNGKTIIVHLNESVKIECTRPSNNTRTSIRIGPGQAFYAT
```

FIG. 17A cont'd

```
GQVIGDIREAHCNISESKWNETLQRVSKKLKEYFPEKNITFQPSSGGDLEITTHSFNCGGEFFYCNTSSLFNRTYMA
NSTETNSTRTITIRCRIKQIINMWQEVGRAMYAPPIAGNITCISNITGLLLTRDGGENNTETFETFRPGGGNMKDNW
RSELYKYKVVEVKPLGVAPTNARRRAVEREKRAVGMGAVFLGFLGAAGSTMGAASITLTVQARQLLSGIVQQQSNLL
KAIEAQQEMLKLTVWGIKQLQARVLALERYLKDQQLLGMWGCSGKLICTTNVYWNSSWSNKTYGDIWDNMTWMQWER
EISNYTEIIYELLEESQNQQEKNEQDLLALDRWNSLWNWFNITNWLWYIKIFIMIVGGLIGLEIIPAVLSLVNRVRQ
GYSPLSLQTLIPSPRGPDRPGGIEEEGGEQDRNRSTRLVSGFLALAWDDLRSLCLFIYHRLRDFILIAARAGELLGR
SSLKGLRRGWEALKYLGSLVQYWGLELKRSAISLLDTLAIAVGEGTDRILKPVLGICRAIRNIPTRIRQGFETALL*
>703010505.w53.25
MRVMGIQRNYPQWWIWSMLGLWMLMICNGMWVTVYYGVPVWKEAKTTLFCASDAKAYEKEVHNVWATHACVPTDPNP
QEMVLKNVTENFNMWENDMVDQMHEDVISLWDQSLKPCVKLTPLCVTLNCTDATASNATASNATASNSSIIEGMKNC
SFNITTELRDKREKKNALFYKLDIVQLDGNSSQYRLINCNTSVITQACPKVSFDPIPIHYCAPAGYAILKCNNKTFN
GTGPCNNVSTVQCTHGIKPVVSTQLLLNGSLAEGEIIRSENITDNGKTIIVHLNESVKIECTRPSNNTRTSIRIGP
GQAFYATGQVIGDIREAHCNISENKWNETLQRVSKKLKEYFPHKNITFQPSSGGDLEITTHSFNCGGEFFYCNTSSL
FNRTYMANSTDMANSTETNSTRTITIRCRIKQIINMWQEVGRAMYAPPIAGNITCISNITGLLLTRDGGKNNTETFE
TFRPGGGNMKDNWRSELYKYKVVEVKPLGVAPTNARKRVVEREKRAVGMGAVFLGFLGAAGSTMGAASITLTVQARQ
LLSGIVQQQSNLLKAIEAQQHMLKLTVWGIKQLQARVLALERYLKDQQLLGMWGCSGKLICTTNVYWNSSWSNKTYG
DIWDNMTWMQWEREISNYTEIIYELLEESQNQQEKNEQDLLALDRWNSLWNWFNITNWLWYIKIFIMIVGGLIGLRI
IFAVLSLVNRVRQGYSPLSLQTLIPSPRGPDRPGGIEEEGGEQDRKRSTRLVSGFLALVWDDLRSLCLFIYHELRDF
ILIAARAGELLGRSSLKGLRRGWEALKYLGSLVQYWGLELKRSAISLLDTLAIAVGEGTDRILEFALGICRAIRNIP
TRIRQGFETALL*
>703010505.w53.19
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTDATASNATAGNATASNSSIIEEMKNC
SFNITTELRDKREKKNALFYKLDIVQLDGNSSQYRLINCNTSAITQACPKVSFDPIPIHYCAPAGYAILKCNNKTFN
GTGPCNNVSTVQCTHGIKPVVSTQLLLNGSLAEGEIIRSENITDNGKTIIVHLNESVKIECTRPSNNTRTSIRIGP
GQAFYATGQVIGDIREAHCNISESKWNETLQRVSKKLKEYFPHKNITFQPSSGGDLEITTHSFNCGGEFFYCNTSSL
FNRTYMANSTETNSTRIITIHCRIKQIINMWQEVGRAMYAPPIAGNITCISNITGLLLTRDGGKNNTETFRPGGGNM
KDNWRSELYKYKVVEVKPLGVAPTNARRRVVEREKRAVGMGAVFLGFLGAAGSTMGAASITLTVQARQLLSGIVQQQ
SNLLKAIEAQQHMLKLTVWGIKQLQARVLALERYLKDQQLLGMWGCSGKLICTTNVYWNSSWSNKTYGDIWDNMTWM
QWEREISNYTEIIYELLEESQNQQEKNEQDLLALDRWNSLWNWFNITNWLWYIKIFIMIVGGLIGLRIIFAVLSLVN
RVRQGYSPLSLQTLIPSPRGPDRPGGIEEEGGEQDRNRSTRLVSGFLALAWDDLRSLCLFIYHRLRDFILIAARAGE
LLGRSSLKGLRRGWEALKYLGSLVQYWGLELKGSAISLLDTLAIAVGEGTDRILEFVLGICRAIRNIPTRIRQGFET
ALL*
>703010505.w53.22
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNANATASNSSIIEGMNSSIIEGMKNC
SFNITTELRDKREKKNALFYKLDIVQLDGNSSQYRLINCNTSVITQACPKVSFDPIPIHYCAPAGYAILKCNNKTFN
GTGPCNNVSTVQCTHGIKPVVSTQLLLNGSLAEGEIIRSENITDNGKTIIVHLNESVKIECTRPSNNTRTSIRIGP
GQAFYATGQVIGDIREAHCNISESKWNETLQRVSKKLKEYFPHKNITFQPSSGGDLEITTHSFNCGGEFFYCNTSSL
FNRTYMATSTDMANSTETNSTRIITIRCRIKQIINMWQEVGRAMYAPPIAGNITCISNITGLLLTRDGGKNNTETFE
TFRPGGGNMKDNWRSELYKYKVVEVKPLGVAPTNARRRVVEREKRAVGMGAVFLGFLGAAGSTMGAASITLTVQARQ
LLSGIVQQQSNLLKAIEAQQHMLKLTVWGIKQLQARVLALERYLKDQQLLGMWGCSGKLICTTNVYWNSSWSNKTYG
DIWDNMTWMQWEREISNYTEIIYELLEESQNQQEKNEQDLLALDRWNSLWNWFNITNWLWYIKIFIMIVGGLIGLRI
IFAVLSLVNRVRQGYSPLSLQTLIPSPRGPDRPGGIEEEGGEQDRNRSTRLVSGFLALAWDDLRSLCLFIYHRLRDF
ILIAARAGELLGRSSLKGLRRGWEALKYLGSLVQYWGLELKRSAISLLDTLAIAVGEGTDRILEFVLGICRAIRNIP
TRIRQGFETALL*
>703010505.w53.8
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTTANATASNSSIIEGMKNCSFNITTEL
RDKREKKNALFYKLDIVQLDGNSSQYRLINCNTSAITQACPKVSFDPIPIHYCAPAGYAILKCNNKTFNGTGPCNNV
STVQCTHGIKPVVSTQLLLNGSLAEGEIIRSENITDNGKTIIVHLNESVKIECTRPSNNTRTSIRIGPGQAFYATG
QVIGDIREAHCNISESKWNETLQRVSKKLKEYFPQKNITFQPSSGGDLEITTHSFNCGGEFFYCNTSSLFNRTYMAT
STDMANSTETNSTRIITIRCRIKQIINMWQEVGRAMYAPPIAGNITCISNITGLLLTRDGGKNNTETFETFRPGGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYGDIWDNMTW
MQWEREISNYTELIYELLEESQNQQEKNEQDLLALDRWNSLWNWFNITNWLWYIKIFIMIVGGLIGLEIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w53.24
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTTANATASNSSIIEGMKNCSFNITTEL
RDKREKKNALFYKLDIVQLDGNSSQYRLINCNTSVITQACPKVSFDPIPIHYCAPAGYAILKCNNKTFNGTGPCNNV
STVQCTHGIKPVVSTQLLLNGSLAEGEIIRSENITDNGKTIIVHLNESVKIECTRPSNNTRTSIRIGPGQAFYATG
QVIGDIREAHCNISESKWNETLQRVSKKLKEYFPHKNITFQPSSGGDLEITTHSFNCGGEFFYCNTSSLFNRTYMAT
STDMANSTETNSTRIIITIRCRIKQIINMWQEVGRAMYAPPIAGNITCISNITGLLLTRDGGKNNTETFETFRPGGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYGDIWDNMTW
MQ*EREISNYTELIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAVRAG
```

FIG. 17A cont'd

ELLGRSSLKGLRRGWEALKYLGSLVQYWGLELKRSAISLLDTLAIAVGEGTDRILEFVLGICRAIRNIPTRIRQGFE
TALL*
>703010505.w53.31
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTDATASNATASNSSIIEGMKNC
SFNITTELRDKREKKNALFYKLDIVQLDGNSSQYRLINCNTSVITQACPKVSFDPIPIHYCAPAGYAILKCNNKTFN
GTGPCNNVSTVQCTHGIKPVVSTQLLLNGSLAEGEIIIRSENITDNGKTIIVHLNESVKIECTRPSNNTRTSIRIGP
GQAFYATGQVIGDIREAHCNISESKWNETLQRVSKKLKEYFPHKNITFQPSSGGDLEITTHSFNCGGEFFYCNTSSL
FNRTYMANSTETNSTRIITIRCRIKQIINMWQEVGRAMYAPPIAGNITCISNITGLLLTRDGGKNNNTETFRPGGGNM
KDNWRSELYKYKVVEVKPLGVAPTNARRRVVEREKRAVGMGAVFLGFLGAAGSTMGAASITLTVQARQLLSGIVQQQ
SNLLKAIGAQQHMLKLTVWGIKQLQARVLALERYLKDQQLLGMWGCSGKLICTTNVYWNSSWSNKTYGDIWDNMTWM
QWEREISNYTEMIYELLEESQNQQEKNEQDLLALDRWNSLWNWFNITNWLWYIKIFIMIVGGLIGLRIIFAVLSLVN
RVRQGYSPLSLQTLIPSPRGPDRPGGIEEEGGEQDRKRSTRLVSGFLALVWDDLRSLCLFIYHRLEDFILIAARAGE
LLGRSSLKGLRRGWEALKYLGSLVQYWGLELKRSAISLLDTLAIAVGEGTDRILEFALGICRAIRNIPTRIRQGFET
ALL*
>703010505.w53.9
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCINANATASNSSIIEGMNSSIIEGMKNC
SFNITTELRDKREKKNALFYKLDIVQLDGNSSQYRLINCNTSVITQACPKVSFDPIPIHYCAPAGYAILKCNNKTFN
GTGPCNNVSTVQCTHGIKPVVSTQLLLNGSLAEGEIIIRSENITDNGKTIIVHLNESVKIECTRPSNNTRTSIRIGP
GQAFYATGQVIGDIREAHCNISESKWNETLQRVSEKLKEYFPHKNITFQPSSGGDLEITTHSFNCGGEFFYCNTSSL
FNRTYMATSTDMANSTETNSTRIITIRCRIKQIINMWQEVGRAMYAPPIAGNITCISNITGLLLTRDGGKNNTETFE
TFRPGGGNMKDNWRSELYKYKVVEVKPLGVAPTNARREVVEREKRAVGMGAVFLGFLGAAGSTMGAASITLTVQARQ
LLSGIVQQQSNLLKAIEAQQHMLKLTVWGIKQLQARVLALERYLKDQQLLGMWGCSGKLICTTNVYWNSSWSNKTYG
DIWDNMTWMQWEREISNYTEIIYELLEESQNQQEKNEQDLLALDRWNSLWNWFNITNWLWYIKIFIMIVGGLIGLRI
IFAVLSLVNRVRQGYSPLSLQTLIPSPRGPDRPGGIEEEGGEQDRNRSTRLVSGFLALAWDDLRSLCLFIYHRLEDF
ILIAARAGELLGRSSLKGLRRGWEALKYLGSLVQYWGLELKRSAISLLDTLAIAVGEGTDRILEFVLGICRAIRNIP
TRIRQGFETALL*
>703010505.w53.32
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTVNANATASNSSIIEGMNSSIIEGMKNC
SFNITTELRDKREKKNALFYKLDIVQLDGNSSQYRLINCNTSVITQACPKVSFDPIPIHYCAPAGYAILKCNNKTFN
GTGPCNNVSTVQCTHGIKPVVSTQLLLNGSLAEGEIIIRSENIIDNGKTIIVHLNESVKIECTRPSNNTRTSIRIGP
GQAFYATGQVIGDIREAHCNISESKWNETLQRVSEKLKEYFPHKNITFQPSSGGDLEITTHSFNCGGEFFYCNTSSL
FNRTYMATSTDMANSTETNSTRIITIRCRIKQIINMWQEVGRAMYAPPIAGNITCISNITGLLLTRDGGKNNTETFE
TFRPGGGNMKDNWRSELYKYKVVEVKPLGVAPTNARREVVEREKRAVGMGAVFLGFLGAAGSTMGAASITLTVQARQ
LLSGIVQQQSNLLKAIEAQQHMLKLTVWGIKQLQARVLALERYLKDQQLLGMWGCSGKLICTTNVYWNSSWSNKTYG
DIWDNMTWMQWEREISNYTEIIYELLEESQNQQEKNEQDLLALDRWNSLWNWFNITNWLWYIKIFIMIVGGLIGLRI
IFAVLSLVNRVRQGYSPLSLQTLIPSPRGPDRPGGIEEEGGEQDRNRSTRLVSGFLALAWDDLRSLCLFIYHRLEDF
ILIAARAGELLGRSSLKGLRRGWEALKYLGSLVQYWGLELKRSAISLLDTLAIAVGEGTDRILEFVLGICRAIRNIP
TRIRQGFETALL*
>703010505.w53.21
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTDANATASNSSIIEGMKNCSFNITTEL
RDKREKKNALFYKLDIVQLDGNSSQYRLINCNTSVITQACPKVSFDPIPIHYCAPAGYAILKCNNKTFNGTGPCNNV
STVQCTHGIKPVVSTQLLLNGSLAEGEIIIRSENITDNGKTIIVHLNESVKIECTRPSNNTRTSIRIGPGQAFYATG
QVIGDIREAHCNISESKWNETLQRVSKKLKEYFPHKNITFQPSSGGDLEITTHSFNCGGEFFYCNTSSLFNRTYMAN
STETNSTRIITIRCRIKQIINMWQEVGRAMYAPPIAGNITCISNITGLLLTRDGGKNNTETFETFRPGGGNMKDNWR
SELYKYKVVEVKPLGVAPTNARRRVVEREKRAVGMGAVFLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNKTYGDIWDNMTWMQWERE
ISNYTEIIYELLEESQNQQEKNEQDLLALDRWNSLWNWFNITNWLWYIKIFIMIVGGLIGLRIIFAVLSLVNRVRQG
YSPLSLQTLIPSPRGPDRPGGIEEEGGEQDRNRSTRLVSGFLALAWDDLRSLCLFIYHRLEDFILIAARAGELLGRS
SLKGLRRGWEALKYLGSLVQYWGLELKRSAISLLDTLAIAVGEGTDRILEFVLGICRAIRNIPTRIRQGFETALL*
>703010505.w53.11
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNANATASNSSIIEGMNSSIIEGMKNC
SFNITTELRDKREKKNALFYKLDIVQLDGNSSQYRLINCNTSVITQACPKVSFDPIPIHYCAPAGYAILKCNNKTFN
GTGPCNNVSTVQCTHGIKPVVSTQLLLNGSLAEGEIIIRSENITDNGKTIIVHLNESVKIECTRPSNNTRTSIRIGP
GQAFYATGQVIGDIREAHCNISESKWNETLQRVSEKLKEYFPHKNITFQPSSGGDLEITTHSFNCGGEFFYCNTSSL
FNRTYMATSTDMANSTETNSTRIITIRCRIKQIINMWQEVGRTMYAPPIAGNITCISNITGLLLTRDGGKNNTETFE
TFRPGGGNMKDNWRSELYKYKVVEVKPLGVAPTNARRRVVEREKRAVGMGAVFLGFLGAAGSTMGAASITLTVQARQ
LLSGIVQQQSNLLKAIEAQQHMLKLTVWGIKQLQARVLALERYLKDQQLLGMWGCSGKLICTTNVYWNSSWSNKTYG
DIWDNMTWMQWEREISNYTEKIYELLEESQNQQEKNEQDLLALDRWNSLWNWFNITNWLWYIKIFIMIVGGLIGLRI
IFAVLSLVNRVRQGYSPLSLQTLIPSPRGPDRPGGIEEEGGEQDRNESTRLVSGFLALAWDDLRSLCLFIYHRLEDF
ILIAARAGELLGRSSLKGLRRGWEALKYLGSLVQYWGLELKRSAISLLDTLAIAVGEGTDRILEFVLGICRAIRNIP
TRIRQGFETALL*
>703010505.w53.16
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNANATASNSSIIEGMNSSIIEGMKNC
SFNITTELRDKREKKNALFYKLDIVQLDGNSSQYRLINCNTSVITQACPKVSFDPIPIHYCAPAGYAILKCNNKTFN

FIG. 17A cont'd

```
GTGPCNNVSTVQCTHGIKPVVSTQLLLNGSLAEGEIIIRSENITDNGKTIIVHLNESVKIECTRPSNNTPTSIRIGP
GQAFYATGQVIGDIREAHCNISESKWNETLQRVSEKLKEYFPHKNITFQPSSGGDLEITTHSFNCGGEFFYCNTSSL
FNRTYMATSTDMANSTETNSTRIITIRCRIKQIINMWQEVGRAMYAPPIAGNITCISNITGLLLTRDGGKNNTETFE
TFRPGGGNMKDNWRSELYKYKVVEVKPLGVAPTNARRRVVEREKRAVGMGAVFLGFLGAAGSTMGAASITLTVQARQ
LLSGIVQQQSNLLKAIEAQQHMLKLTVWGIKQLQARVLALERYLKDQQLLGMWGCSGKLICTTNVYWNSSWSNKTYG
DIWDNMTWMQWEREISNYTEIIYELLEESQNQQEKNEQDLLALDRWNSLWNWFNITNWLWYIKIFIMIVGGLIGLRI
IFAVLSLVNFVRQGYSPLSLQTLIPSPRGPDRPGGIEEEGGEQDRNRSTRLVSGFLALAWDDLRSLCLFIYHRLRDF
ILIAARAGELLGRSSLKGLRRGWEALKYLGSLVQYWGLELKRSAISLLDTLAIAVGEGTDRILEFVLGICRAIRNIP
TRIRQGFETALL*
>703010505.w53.4
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVVKLTPLCVTLNCTINANATASNSSTIEGMNSSIIEGMKNC
SFNITTELQLDGNSSQYRLINCNTSVITQACPKVSFDPIPIHYCAPAGYAILKCNNKTFNGTGPCNNVSTVQCTHGI
KPVVSTQLLLNGSLAEGEIIIRSENITDNGKTIIVHLNESVKIECTRPSNNTRTSIRIGPGQAFYATGQVIGDIREA
HCNISESKWNETLQRVSEKLKEYFPHKNITFQPSSGGDLEITTHSFNCGGEFFYCNTSSLFNRTYMATSTDMANSTE
TNSTRIITIRCRIKQIINMWQEVGRAMYAPPIAGNITCISNITGLLLTRDGGKNNTETFETFRPGGGNMKDNWRSEL
YKYKVVEVKPLGVAPTNARRRVVEREKRAVGMGAVFLGFLGAAGSTMGAASITLTVQARQLLSGIVQQQSNLLKAIE
AQQHMLKLTVWGIKQLQARVLALERYLKDQQLLGMWGCSGKLICTTNVYWNSSWSNKTYGDIWDNMTWMQWEREISN
YTEIIYELLEESQNQQEKNEQDLLALDRWNSLWNWFNITNWLWYIKIFIMIVGGLIGLRIIFAVLSLVNRVRQGYSP
LSLQTLIPSPRGPDRPGGIEEEGGEQDRNRSTRLVSGFLALAWDDLRSLCLFIYHRLRDFILIAARAGELLGRSSLK
GLRRGWEALKYLRSLVQYWGLELKRSAISLLDTLAIAVGEGTDRILEFVLGICRAIRNIPTRIRQGFETALL*
>703010505.w53.13
MRVMGRQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTDATASNATASNSSIIEGMNSSIIEGM
KNCSFNITTELRDKREBKKNALFYKLDIVQLDGNSSQYRLINCNTSVITQACPKVSFDPIPIHYCAPAGYAILKCNNK
TFNGTGPCNNVSTVQCTHGIKPVVSTQLLLNGSLAEGEIIIRSENITDNGKTIIVHLNESVKIECTRPSNNTRTSIR
IGPGQAFYATGQVIGDIREAHCNISESKWNETLQRVSEKLKEYFPHKNITFQPSSGGDLEITTHSFNCGGEFFYCNT
SSLFNRTYMATSTDMANSTETNSTRIITIRCRIKQIINMWQEVGRAMYAPPIAGNITCISNITGLLLTRDGGKNNTE
TFETFRPGGGNMKDNWRSELYKYKVVEVKPLGVAPTNARRRVVEREKRAVGMGAVFLGFLGAAGSTMGAASITLTVQ
ARQLLSGIVQQQSNLLKAIEAQQHMLKLTVWGIKQLQARVLALERYLKDQQLLGMWGCSGKLICTTNVYWNSSWSNK
TYGDIWDNMTWMQWEREISDYTEIIYELLEESQNQQEKNEQDLLALDRWNSLWNWFNITNWLWYIKIFIMIVGGLIG
LRIIFAVLSLVNRVRQGYSPLSLQTLIPSPRGPDRPGGIEEEGGEQDRNRSTRLVSGFLALAWDDLRSLCLFIYHRL
RDFILIAARAGELLGRSSLKGLRRGWEALKYLGSLVQYWGLELKRSAISLLDTLAIAVGEGTDRILEFVLGICRAIR
NIPTRIRQGFETALL*
>703010505.w53.1
MRVMGRQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTDATASNATASNSSIIEGMNSSIIEGM
KNCSFNITTELRDKREEKKNALFYKLDIVQLDGNSSQYRLINCNTSVITQACPKVSFDPIPIHYCAPAGYAILKCNNK
TFNGTGPCNNVSTVQCTHGIKPVVSTQLLLNGSLAEGEIIIRSENITDNGKTIIVHLNESVKIECTRPSNNTRTSIR
IGPGQAFYATGQVIGDIREAHCNISESKWNETLQRVSEKLKEYFPHKNITFQPSSGGDLEITTHSFNCGGEFFYCNT
SSLFNRTYMATSTDMANSTETNSTRIITIRCRIKQIINMWQEVGRAMYAPPIAGNITCISNITGLLLTRDGGKNNTE
TFETFRPGGGNMKDNWRSELYKYKVVEVKPLGVAPTNARRRVVEREKRAVGMGAVFLGFLGAAGSTMGAASITLTVQ
ARQLLSGIVQQQSNLLKAIEAQQHMLKLTVWGIKQLQARVLALERYLKLLGMWGCSGKLICTTNVYWNSSWSNKTYG
DIWDNMTWMQWEREISDYTEIIYELLEESQNQQEKNEQDLLALDRWNSLWNWFNITNWLWYIKIFIMIVGGLIGLRI
IFAVLSLVNRVRQGYSPLSLQTLIPSPRGPDRPGGIEEEGGEQDRNRSTRLVSGFLALAWDDLRSLCLFIYHRLRDF
ILIAARAGELLGRSSLKGLRRGWEALKYLGSLVQYWGLELKRSAISLLDTLAIAVGEGTDRILEFVLGICRAIRNIP
TRIRQGFETALL*
>703010505.w53.28
MRVMGRQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTDATASNATASNSSIIEGMNSSIIEGM
KNCSFNITTELRDKREKKNALFYKLDIVQLDGNSSQYRLINCNTSVITQACPKVSFDPIPIHYCAPAGYAILKCNNK
TFNGTGPCNNVSTVQCTHGIKPVVSTQLLLNGSLAEGEIIIRSENITDNGKTIIVHLNESVKIECTRPSNNTRTSIR
IGPGQAFYATGQVIGDIREAHCNISESKWNETLQRVSEKLKEYFPHKNITFQPSSGGDLEITTHSFNCGGEFFYCNT
SSLFNRTYMATSTDMANSTETNSTRIITIRCRIKQIINMWQEVGRAMYAPPIAGNITCISNITGLLLTRDGGKNNTE
TFETFRPGGGNMKDNWRSELYKYKVVEVKPLGVAPTNARRRVVEREKRAVGMGAVFLGFLGAAGSTMGAASITLTVQ
ARQLLSGIVQQQSNLLKAIEAQQHMLKLTVWGIKQLQARVLALERYLKDQQLLGMWGCSGKLICTTNVYWNSSWSNK
TYGDIWDNMTWMQWEREISDYTEIIYELLEESQNQQEKNEQDLLALDRWNSLWNWFNITNWLWYIKIFIMIVGGLIG
LRIIFAVLSLVNRVRQGYSPLSLQTLIPSPRGPDRPGGIEEEGGEQDRNRSTRLVSGFLALAWDDLRSLCLFIYHRL
RDFILIAARAGELLGRSSLKGLRRGWEALKYLGSLVQYWGLELKRSAISLLDTLAIAVGEGTDRILEFVLGICRAIR
NIPTRIRQGFETALL*
>703010505.w78.42
MRVMGIQRNYPQWWIWSMLGLWMLMICNGMWVTVYYGVPVWKEAKTTLFCASDAKAYEKEVHNVWATHACVPTDPNP
QEMVLKNVTENFNMWKNDMADQMHEDVINLWDQSLKPCVKLTPLCVTLNCTDATASNATASNATASNSSINSSIIEE
MKNCSFNITTELRDKREKKNALFYKLDIVQLDGNSSQYRLINCNTSAITQACPKVSFDPIPIHYCAPAGYAILKCNN
KTFNGTGPCNNVSTVQCTHGIKPVVSTQLLLNGSLAEGEIIRSENITDNGKTIIVHLNESVKIECTRPSNNTRTSI
RIGPGQAPYATGQVIGDIREAHCNISESKWNETLQRVSKKLKEYFPHKNITFQPSSGGDLEVTTHSFNCGGEFFYCN
TSSLFNRTDMANSTETNSTRIITIRCRIKQIVNMWQEVGRAMYAPPIAGNITCISNITGLLLTRDGGENNGGKNNTE
TFRPGGGNMKDNWRSELYKYKVVEVKPLGVAPTNARRRVVEREKRAVGMGAVFLGPLGAAGSTMGAASITLTVQARQ
LLSGIVQQQSNLLKAIEAQQHMLKLTVWGIKQLQARVLALERYLKDQQLLGMWGCSGKLICTTNVYWNSSWSNKTYG
DIWDNMTWMQWEREISNYTEIIYELLEESQNQQEKNEQDLLALDRWNSLWNWFNITKWLWYIKIFIMIVGGLIGLRI
```

FIG. 17A cont'd

```
TFAVLSLVNRVRQGYSPLSLQTLIPSPRGPDRPGGIEEEGGEQDRNRSTRLVSGFLALAWDDLRSLCLFIYHRLRDF
ILIAARAGELLGRSSLKGLRRGWEALKYLGGLVQYWGLELKRSAISLLDTLAIAVGEGTDRILEFVLGICRAIRNIP
TRIRQGFETALL*
>703010505.w78.6
MRVMGIQRNYPQWWIWSMLGLWMLMICNGMWVTVYYGVPVWKEAKTTLFCASDAKAYEKEVHNVWATHACVPTDPNP
QEMVLKNVTENFNMWKNDMADQMHEDVISLWDQSLKPCVKLTPLCVTLNCTDATASNATASNATASNSSINSSIIEE
MKNCSFNITTELRDKREKKNALFYKLDIVQLDGNSSQYRLINCNTSAITQACPKVSFDPIPIHYCAPAGYAILKCNN
KTFNGTGPCNNVSTVQCTHGIKPVVSTQLLLNGSLAEGEIIIRSENITDNGKTIIVHLNESVKIECTRPSNNTRTSI
RIGPGQAFYATGQVIGDIREAHCNISESKWNETLQRVSKKLKEYFPHKNITFQPSSGGDLEVTTHSFNCGGEFFYCN
TSSLFNRTDMANSTETNSTRIITIRCRIKQIVNMWQEVGRAMYAPPIAGNITCISNITGLLLTRDGGENNGGKNNTE
TFRPGGGNMKDNWRSELYKYKVVEVKPLGVAPTNARRRVVEREKRAVGMGAVFLGPLGAAGSTMGAASITLTVQARQ
LLSGIVQQQSNLLKAIEAQQHMLKLTVWGIKQLQARVLALERYLKDQQLLGMWGCSGKLICTTNVYWNSSWSNKTYG
DIWDNMTWMQWEREISNYTEIIYELLEESQNQQEKNEQDLLALDRWNSLWNWFNITKWLWYIKIFIMIVGGLIGLRI
IFAVLSLVNRVRQGYSPLSLQTLIPSPRGPDRPGGIEEEGGEQDRNRSTRLVSGFLALAWDDLRSLCLFIYHRLRDF
ILIAARAGELLGRSSLKGLRRGWEALKYLGGLVQYWGLELKRSAISLLDTLAIAVGEGTDRILEFVLGICRAIRNIP
TRIRQGFETALL*
>703010505.w78.34
MRVMGIQRNYPQWWIWSMLGFWTLMICNGMWVTVYYGVPVWKEAKTTLFCASDAKAYEKEVHNVWATHACVPTDPNP
QEMVLKNVTENFNMWKNDMADQMHEDVISLWDQSLKPCVKLTPLCVTLNCTDATASNATASNATASNTTASNSNIIE
EMKNCSFNITTELRDKREKKNALFYKLDIVQLDGNSSQYRLINCNTSVITQACPKVSFDPIPIHYCAPAGYAILKCN
NKTFNGTGPCNNVSTVQCTHGIKPVVSTQLLLNGSLAEGEIIIRSENITDNGKTIIVHLNESVXIECTRPSNNTRTS
IRIGPGQAFYATGQVIGDIREAHCNISESKWNETLQRVSKKLKEYFPHKNITFQPSSGGDLEVTTHSFNCGGEFFYC
NTSSLFNRTDMANSTETNSTRIITIRCRIKQIVNMWQEVGRAMYAPPIAGNITCISNITGLLLTRDGGENNGGKNNT
ETFRPGGGNMKDNWRSELYKYKVVEVKPLGVAPTNARRRVVEREKRAVGMGAVFLGPLGAAGSTMGAASITLTVQAR
QLLSGIVQQQSNLLKAIEAQQHMLKLTVWGIKQLQARVLALERYLKDQQLLGMWGCSGKLICTTNVYWNSSWSNKTY
GDIWDNMTWMQWEREISNYTEIIYELLEESQNQQEKNEQDLLALDRWNSLWNWFNITKWLWYIKIFIMIVGGLIGLR
IIFAVLSLVNRVRQGYSPLSLQTLIPSPRGPDRPGGIEEEGGEQDRNRSTRLVSGFLALAWDDLRSLCLFIYHRLRD
FILIAARAGELLGRSSLKGLRRGWEALKYLGGLVQYWGLELKRSAISLLDTLAIAVGGGTDRILEFVLGICRAIRNI
PTRIRQGFETALL*
>703010505.w78.16
MRVMGIQSNYPQWWIWSMLGLWMLMICNGMWVTVYYGVPVWKEAKTTLFCASDAKAYEKEVHNVWATHACVPTDPNP
QEMVLKNVTENFNMWKNDMADQMHEDVISLWDQSLKPCVKLTPLCVTLNCTDATTNATASNATASNSSITEG
MKNCSFNITTELRDKTEKKNALFYKLDIVQLDGNSSQYRLINCNTSVITQACPKVSFDPIPIHYCAPAGYAILKCNN
KTFNGTGPCNNVSTVQCTHGIKPVVSTQLLLNGSLAEGEIIIRSENITDNGKTIIVHLNESVKIECTRPSNNTRTSI
RIGPGQAFYATGQVIGDIREAHCNISESKWNETLQRVSKKLKEYFPHKNITFQPSSGGDLEVTTHSFNCGGEFFYCN
TSSLFNRTDMANSTETNSTRIITIRCRIKQIINMWQEVGRAMYAPPIAGNITCISNITGLLLTRDGGKNNEGKNNTE
TFRPGGGNMKDNWRSELYKYKVVEVKPLGVAPTNARRRVVEREKRAVGMGAVFLGPLGAAGSTMGAASITLTVQARQ
LLSGIVQQQSNLLKAIEAQQHMLKLTVWGIKQLQARVLALERYLKDQQLLGMWGCSGKLICTTNVYWNSSWSNKTYG
DIWDNMTWMQWEREISNYTEIIYDLLEESQNQQEKNEQDLLALDKWNSLWNWFNITKWLWYIKIFIMIVGGLIGLRI
IFAVLSLVNRVRQGYSPLSLQTLIPSPRGPDRPGGIEEEGGEQDRNRSTRLVSGFLALAWDDLRSLCLFIYHRLRDF
ILIAVRAGELLERSSLKGLRRGWEALKYLGGLVQYWGLELKRSAISLLDTLAIAVGEGTDRILEFVLGICRAIRNIP
TRIRQGFETALL*
>703010505.w78.36
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLTPCVKLTPLCVTLNCTDATASNATASNATASNATASSSIIE
EMKNCSFNITTELRDKREKKNALFYKLDIVQLDGNSSQYRLINCNTSVITQACPKVSFDPIPIHYCAPAGYAILKCN
NKTFNGTGPCNNVSTVQCTHGIKPVVSTQLLLNGSLAEGEIIIRSENITDNGKTIIVHLNESVXIECTRPSNNTRTS
IRIGPGQAFYATGQVIGDIREAHCNISESKWNETLQRVSKKLKEYFPHKNITFQPSSGGDPEITTHSFNCGGEFFYC
NTSSLFDRTYMANSTETNSTRIITIRCRIKQIINMWQEVGRAMYAPPIAGNITCISNITGLLLTRDGGNSSTETPFRP
GGGNMKDNWRSELYKYKVVEVKPLGVAPTNARRRVVEREKRAVGMGAVFLGPLGAAGSTMGAASITLTVQARQLLSG
IVQQQSNLLKAIEAQQHMLKLTVWGIKQLQARVLALERYLKDQQLLGMWGCSGKLICTTNVYWNSSWSNKTYGDIWD
NMTWMQWEREISNYTDIIYELLEESQNQQEKNEQDLLALDRWNSLWNWFNITKWLWYIKIFIMIVGGLIGLRTIFAV
LSLVNRVRQGYSPLSLQTLIPSPRGPDRPGGIEEEGGEQDRNRSTRLVSGFLAFAWDDLRSLCLFIYHRLRDFILIA
ARAGELLGRSSLKGLRRGWEALKYLGGLVQYWGLELKKSAISLLDTLAIAVGEGTDRILEFVLGICRAIRNIPTRTR
QGFETALL*
>703010505.w78.32
MRVMGRQRNYPQWWIWSMLGLWMLMICNGMWVTVYYGVPVWKEAKTTLFCASDAKAYEKEVHNVWATHACVPTDPNP
QEMVLKNVTENFNMWKNDMVDQMHEDVISLWDQSLTPCVKLTPLCVTLNCTDATASNATASNATASNATASNSSIII
EGMKNCSPNITTELRDKREKKNALFYKLDIVQLDGNSSQYRLINCNTSVITQACPKVSFDPIPIHYCAPAGYAILKC
NNKTFNGTGPCNNVSTVQCTHGIKPVVSTQLLLNGSLAEGEIIIRSKNITDNGKTIIVHLNESVKIECTRPSNNTRT
SIRIGPGQAFYATGQVIGDIREAHCNISESKWNETLQRVSKKLKEYFPNKNITFQPSSGGDLEITTHSFNCGGEFFY
CNTSSLFNRTYMANSTETNSTRIITIRCRIKQIINMWQEVGRAMYAPPIAGNITCISNITGLLLTRDGGKNNTETFE
TFRPGGGNMKDNWRSELYKYKVVEVKPLGVAPTNARRRVVEREKRAVGMGAVFLGPLGAAGSTMGAASITLTVQARQ
LLSGIVQQQSNLLKAIEAQQHMLRLTVWGIKQLQARVLALERYLKDQQLLGMWGCSGKLICTTNVYWNSSWSNKTYG
DIWDNMTWMQWEREISNYTETIYELLEESQNQQEKNEQDLLALDRWNSLWNWFNITKWLWYIKIFIMIVGGLIGLRI
IFAVLSLVNRVRQGYSPLSLQTLIPSPRGPDRPGGIEEEGGEQDRKRSTRLVSGFLALVWDDLRSLCLFIYHRLRDF
ILIAARAGELLGRSSLKGLRRGWEALKYLGGLVQYWGLELKRSAISLLDTLAIAVGEGTDRILEFVLGICRAIRNIP
TRIRQGFETALL*
>703010505.w78.41
```

FIG. 17A cont'd

```
MRVMGIQRNYPQWWIWGMLGFWMLMICNGMWVTVYYGVPVWKEAKTTLFCASDAKAYEKEVHNVWATHACVPTDPNP
QEMVLKNVTENFNMWKNDMADQMHEDVISLWDQSLKPCVKLTPLCITLNCTDATASNATASNATASSIIEGM
KNCSFNITTELRDKIEKRNALFYKLDIVQLDGNSSQYRLINCNTSVITQACPKVSFDPIPIHYCAPAGYAILKCNNK
TFNGTGPCNNVSTVQCTHGIKPYVSTQLLLNGGLAEGEIIIRSENITDNGKTIIVHLNESVKIECTRPSNNTRTSIR
IGPGQAFYATGQVIGDIREAHCNISESKWNETLQRVSEKLKEYFPNKNITFQPSSGGDLEITTHSFNCGGEFFYCNT
SSLFNRTYMANSTDMANSTETNSTRIITIRCRIKQIINMWQEVGRAMYAPPIAGNITCISNITGLLDTRDGGKNNTE
TFETFRPEGGNMKDNWRSELYKYKVVEVKPLGVAPTNARRRVVEREKRAVGMGAVFLGFLGAAGSTMGAASITLTVQ
ARQLLSGIVQQQSNLLKAIEAQQHMLKLTVWGIKQLQARVLALERYLKDQQLLGMWGCSGKLICTTNVYWNSSWSNK
TYGDIWDNMFWMQWEREISNYTEMIYELLEESQNQQEKNEQDLLALDRWNSLWNWFNITKWLWYIKIFIMIVGGLIG
LRIIFAVLSLVNRVRQGYSPLSLQTLIPSPRGPDRPGGIEEEGGEQDRERSTRLVSGFLALVWDDLRSLCLFIYHRL
RDFILIAARAGELLGRSSLKGLRRGWEALKYLGSLVQYWGLELKRSAISLLDTLAIAVGEGTDRILEFVLGICRAIR
NIPTRIRQGFETALL*
>703010505.w78.4
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTDATASNATASNATASNSSILE
GMKNCSFNITTELRDKREKKNALFYKLDIVQLGGNSSQYRLINCNTSVITQACPKVSFDPIPIHYCAPAGYAILKCN
NKTFNGTGPCNNVSTVQCTHGIKPVVSTQLLLNGSLAEGEIIIRSKNITDNGKTIIVHLNESVKIECTRPSNNTRTS
IRIGPGQAFYATGQVIGDIREAHCNISESKWNETLQRVSEKLKEYFPQKNITFQPSSGGDLEITTHSFNCGGEFFYC
NTSSLFNRTYMATSTDMANSTETNSTRIITIRCRIKQIINMWQEVGRAMYAPPIAGNITCISNITGLLLTRDGGENN
TETFETFRPGGGNMKDNWRSELYKYKVVEVKPLGVAPTNARREVVEREKRAVGMGAVFLGFLGAAGSTMGAASITLT
VQARQLLSGIVQQQSNLLKAIEAQQHMLKLTVWGIKQLQARVLALERYLKDQQLLGMWGCSGKLICTTNVYWNSSWS
NKTYGDIWDNMTWMQWEREISNYTETIYELLEESQNQQEKNEQDLLALDRWNSLWNWFNITNWLWYIKIFIMIVGGL
IGLRIIFAVLSLVNRVRQGYSPLSLQTLIPSPRGPDRPGGIEEEGGEQDRNRSTRLVSGFLALAWDDLRSLCLFIYH
RLRDFILIAARAGELLGRSSLKGLRFGWEALKYLGSLVQYWGLELKRSAISLLDTLAIAVGEGTDRILEFVLGICRA
IRNIPTRIRQGFETALP*
>703010505.w78.25
MRVMGRQRNYPQWWINSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLTPCVKLTPLCVTLNCTDATASNATASNATASNATASNSSIII
EGMKNCSFNITTELRDKREKKNALFYKLDIVQLDGNSSQYRLINCNTSVITQACPKVSFDPIPIHYCAPAGYAILKC
NNKTFNGTGPCNNVSTVQCTHGIKPVVSTQLLLNGSLAEGEIIIRSKNITDNGKTIIVHLNESVKIECTRPSNNTRT
SIRIGPGQAFYATGQVIGDIREAHCNISESKWNETLQRVSEKLKEYFPNKNITFQPSSGGDLEITTHSFNCGGEFFY
CNTSSLFNRTYMANSTDMANSTETNSTRIITIRCRIKQIINMWQEVGRAMYAPPIAGNITCISNITGLLLTRDGGKN
NTETFETFRPGGGNMKDNWRSELYKYKVVEVKPLGVAPTNARRRVVEREKRAVGMGAVFLGFLGAAGSTMGAASITL
TVQARQLLSGIVQQQSNLLKAIEAQQHMLKLTVWGIKQLQARVLALERYLKDQQLLGMWGCSGKLICTTNVYWNSSW
SNKTYGDIWDNMTWMQWEREISNYTEMIYELLEESQNQQEKNEQDLLALDRWNSLWNWFNITKWLWYIKIFIMIVGG
LIGLRIIFAVLSLVNRVRQGYSPLSLQTLIPSPRGPDRPGGIEEEGGEQDRKRSTRLVSGFLALAWDDLRSLCLFIY
HRLRDFILIAARAGELLGRSSLKGLRRGWEALKYLGSLVQYWGRELKRSAISLLDTLAIAVGEGTDRILEFALRICR
AIRNMPTRIRQGFETALL*
>703010505.w78.9
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTDATASNATASNATASNATASNSSIII
EGMKNCSFNITTELRDKREKKNALFYKLDIVQLDGNSSQYRLINCNTSVITQACPKVSFDPIPIHYCAPAGYAILKC
NNKTFNGTGPCNNVSTVQCTHGIKPVVSTQLLLNGSLAEGEIIIRSKNITDNGKTIIVHLNESVKIECTRPSNNTRT
SIRIGPGQAFYATGQVIGDIREAHCNISESKWNETLQRVSKKLKEYFPQRNITFQPSSGGDLEITTHSFNCGGEFFY
CNTSSLFNRTYMANSTDMANSTETNRTITIRCRIKQIINMWQEVGRAMYAPPIAGNITCISNITGLLLTRDGGKNNT
ETFETFRPGGGNMKDNWRSELYKYKVVEVKPLGVAPTNARREVVEREKRAVGMGAVFLGFLGAAGSTMGAASITLTV
QARQLLSGIVQQQSNLLKAIEAQQHMLKLTVWGIKQLQARVLALERYLKDQQLLGMWGCSGKLICTTNVYWNSSWSN
KTYGDIWDNMTWMQWEREISNYTEMIYELLEESQNQQEKNEQDLLALDRWNSLWNWFNITKWLWYIKIFIMIVGGLI
CLRIIFAVLSLVNRVRQGYSPLSLQTLIPSPRGPDRPGGIEEEGGEQDRKRSTRLVSGFLALVWDDLRSLCLFIYHR
LRDFILIAARAGELLGRSSLKGLRRGWEALKYLGSLVQYWGLELKRSAISLLDTLAIAVGEGTDRILEFALGICRAI
RNIPTRIRQGFETALL*
>703010505.w78.26
MRVMGRQRNYPQWWINSMLGLWMLMICNGMWVTVYYGVPVWKEAKTTLFCASDAKAYEKEVHNVWATHACVPTDPNP
QEMVLKNVTENFNMWKNDMVDQMHEDVISLWDQSLTPCVKLTPLCVTLNCTDATASNATASNATASNATASNSSIII
EGMKNCSFNITTELRDKREKKNALFYKLDIVQLDGNSSQYRLINCNTSVITQACPKVSFDPIPIHYCAPAGYAILKC
NNKTFNGTGPCNNVSTVQCTHGIKPVVSTQLLLNGSLAEGEIIIRSKNITDNGKTIIVHLNESVKIECTRPSNNTRT
SIRIGPGQAFYATGQVIGDIREAHCNISESKWNETLQRVSEKLKEYFPNKNITFQPSSGGDLEITTHSFNCGGEFFY
CNTSSLFNRTYMFNSTDMANSTETNSTRIITIRCRIKQIINMWQEVGRAMYAPPIAGNITCISNITGLLLTRDGGNS
STETFRPGGGNMKDNWRSELYKYKVVEVKPLGVAPTNARRRVVEREKRAVGMGAVFLGFLGAAGSTMGAASITLTVQ
ARQLLSGIVQQQSNLLKAIEAQQHMLKLTVWGIKQLQARVLALERYLKDQQLLGMWGCSGKLICTTNVYWNSSWSNK
TYGDIWDNMTWMQWEGEISNYTEIIYKLLEESQNQQEKNEQDLLALDRWNSLWNWPNITNWLWYIKIFIMIVGGLIG
LRIIFAVLSLVNRVRQGYSPLSLQTLIPSPRGPDRPGGIEEEGGEQDRKRSTRLVSGFLALAWDDLRSLCLFIYHRL
RDFILIAARAGELLGRSSLKGLRRGWEALKYLGSLVQYWGRELKRSAISLLDTLAIAVGEGTDRILEFALGICRAIR
NIPTRIRQGFETALL*
>703010505.w78.29
MRVMGIQRNYPQWWIWSMLGLWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCADATTNATASNATASNATASNSSIIEG
MKNCSFNITTELRDKREKKNALFYKLDIVQLDGNSSQYRLINCNTSVITQACPKVSFDPIPIHYCAPAGYAILKCNN
KTFNGTGPCNNVSTVQCTHGIKPVVSTQLLLNGSLAEGEIIIRSENITDNGKTIIVHLNESVKIECTRPSNNTRTSI
RIGPGQAFYATGQVIGDIREAHCNISESKWNETLQRVSKKLKEYFPLKNITFQPSSGGDLEITTHSFNCGGEFFYCN
```

FIG. 17A cont'd

```
TSSLFNRTYMANSTDMANSTETNSTRIITIRCRIKQIINMWQEVGRAMYAPPIAGNITCISNITGLLLTPDGGNNTN
TETFRPGGGNMKDNWRSELYKYKVVEVKPLGVAPTNARRRVVEREKRAVGMGAVFLGFLGAAGSTMGAASITLTVQA
RQLLSGIVQQQSNLLKAIEAQQHMLKLTVWGIKQLQARVLALERYLKDQQLLGMWGCSGKLICTTNVYWNSSWSNKT
YGDIWDNMTWMQWEREISNYTELIYELLEESQNQQEKNEQDLLALDRWNSLWNWFNITNWLWYIKIFIMIVGGLIGL
RIIFAVLSLVNRVRQGYSPLSLQTLIPSPRGPDRPGGIEEEGGEQDRNRSTRLVSGFLALAWDDLRSLCLFIYHRLR
DFILIAARAGELLGRSSLKGLRRGWEALKYLGGLVQYWGLELKRSAISLLDTLAIAVGEGTDRILEFVLGICRAIRN
IPTRIRQGFETALL*
>703010505.w78.5
MRVMGIQRNYPQWWIWSMLGLWMLMICNGMWVTVYYGVPVWKEAKTTLFCASDAKAYEKEVHNVWATHACVPTDPNP
QEMVLKNVTENFNMWKNDMADQMHEDVISLWDQSLKPCVKLTPLCVTLNCTDANATASNTNATASNINATASNSSII
EGMKNCSFSITTELRDKREKKYALFYKLDIVQLDGNSSQYRLINCNTSVITQACPKVSFDPIPIHYCAPAGYAILKC
NNKTFNGTGPCNNVSTVQCTHGIKPVVSTQLLLNGSLAEGEIIIRSENITDNGKTIIVHLNESVKIECTRPSNNTRT
SIRIGPGQAFYATGQVIGDIREAHCNISESKWNETLQRVSKKLEEYFPHKDITFQPSSGGGDLEVTTHSFNCGGEFFY
CNTSSLFNRTYMANSTDMANSTETNSTRIITIRCRIKQIINMWQEVGRAMYAPPIAGNITCISKITGLLLTRDGGKN
RDRGKNNTETFRPGGGNMKDNWRSELYKYKVVEVKPLGVAPTNARRRVVEREKRAVGMGAVFLGFLGAAGSTMGAAS
ITLTVQARQLLSGIVQQQSNLLKAIEAQQHMLKLTVWGIKQLQARVLALERYLKDQQLLGMWGCSGKLICTTNVYWN
SSWSNKTYGDIWDNMTWMQWEREISNYTEIIYDLLEESQNQQEKNEQDLLALDRWNSLWNWFNITKWLWYIKIFIMI
VGGLIGLRIIFAVLSLVNRVRQGYSPLSLQTLIPSPRGPDRPGGIEEEGGEQDRNRSTRLVSGFLALAWDDLRSLCL
FIYHRLRDFILIAARAGELLGRSSLKGLRRGWEALKYLGGLVQYWGLELKRSAISLLDTLAIAVGEGTDRILEFVLG
ICRAIRNIPTRIRQGFETALL*
>703010505.w78.30
MRVMGIQRNYPQWWIWSMLGLWMLMICNGMWVTVYYGVPVWKEAKTTLFCASDAKAYEKEVHNVWATHACVPTDPNP
QEMVLKNVTENFNMWKNDMADQMHEDVISLWDQSLKPCVKLTPLCVTLNCTDANATASNTNATASNINATASDSSII
EGMKNCSFNITTELRDKREKKYALFYKLDIVQLDGNSSQYRLINCNTSVITQACPKVSFDPIPIHYCAPAGYAILKC
NNKTFNGTGPCNNVSTVQCTHGLKPVVSTQLLLNGSLAEGEIIIRSENITNSAKTIIVHLNESVKIECTRPSNNTRT
SIRIGPGQAFYATGQVIGDIRKAHCNISESKWNETLQRVSKKLKEYFPHKNITFQPSSGGDLEVTTHSFNCGGEFFY
CNTSSLFNRTYMANSTETNSTRTITLHCRIKQIINMWQEVGRAMYAPPIAGNITCISNITGLLLTRDGGNNNTETFR
PGGGNMKDNWRSELYKYKVVEVKPLGVAPTNARRRVVEREKRAVGMGAVFLGFLGAAGSTMGAASITLTVQARQLLS
GIVQQQSNLLKAIEAQQHMLKLTVWGIKQLQARVLALERYLKDQQLLGMWGCSGKLICTTNVYWNSSWSNKTYGDIW
DNMTWMQWEREISNYTELIYDLLEESQNQQEKNEQDLLALDRWNSLWNWFNITKWLWYIKIFIMIVGGLIGLRIIPA
VLSLVNRVRQGYSPLSLQTLIPSPRGPDRPGGIEEEGGEQDRNRSTRLVSGFLALAWDDLRSLCLFIYHRLRDFILI
AARAGELLGRSSLKGLRRGWEALKYLGSLVQYWGLELKRSAISLLDTLAIAVGEGTDRILEFVLGICRAIRNIPTRI
RQGFETALL*
>703010505.w78.33
MRVTGIQRNYPQWWIWSMLGLWMLMICNGMWVTVYYGVPVWKEAKTTLFCASDAKAYEKEVHNVWATHACVPTDPNP
QEMVLKNVTENFNMWKNDMADQMHEDVISLWDQSLKPCVKLTPLCVTLNCIDANATASNATASNSSIIEGMKNCSFN
ITTELRDKIEKKNALFYKLDIVQLDGNSSQYRLINCNTSVITQACPKVSFDPIPIHYCAPAGYAILKCNNKTFNGTG
PCNNVSTVQCTHGIKPVVSTQLLLNGSLAEGEIIIRSENITNSAKTIIVHLNESVKIECTRPSNNTRTSIRIGPGQA
FYATGQVIGDIRKAHCNISESKWNETLQRVSKKLKEYFPHKNITPQPSSGGDLEITTHSFNCGGEFFYCNTSSLFNR
TYMANSTETNSTRTITLHCRIKQIINMWQEVGRAMYAPPIAGNITCISNITGLLLTRDGGNNNTTETFRPGGGNMKD
NWRSELYKYKVVEIKPLGVAPTNARRRVVEREKRAVGMGAVFLGFLGAAGSTMGAASITLTVQARQLLSGIVQQQSN
LLKAIEAQQHMLKLTVWGIKQLQARVLALERYLKDQQLLGMWGCSGKLICTTNVYWNSSWSNKTYGDIWDNMTWMQW
EREISDYTEIIYELLEESQNQQEKNEQDLLALDRWNSLWNWFNITNWLWYIKIFIMIVGGLIGLRIIFAVLSLVNRV
RQGYSPLSLQTLTPSPRGPDRPGGIEEEGGEQDRNRSTRLVSGFLALAWDDLRSLCLFIYHRLRDFILIAARAGELL
GRSSLKGLRRGWEALKYLGGLVQYWGLELKRSAISLLDTLAIAVGEGTDRILEFVLGICRAIRNIPTRIRQGFETAL
L*
>703010505.w78.39
MRVMGIQRNYTQWWINSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCANATNATASNSSILEEMKNCSFNITTE
LRDKREKKNALFYKLDIVQLGGNSSQYRLINCNTSVITQACPKVSFDPIPIRYCAPAGYAILKCNNKTFNGTGPCMN
VSTVQCTHGIKPVVSTQLLLNGSLAEGEIIIRSKNITDNGKTIIVHLNESVKIECTRPSNNTRTSIRIGPGQAFYAT
GQVIGDIREAHCNISESKWNETLQRVSEKLKEYFPDKNITFQPSSGGDLEITTHSFNCGGEFFYCNTSSLFNETYMA
NSTETNSTRIITIKCRIKQIINMWQEVGRAMYAPPIAGNITCISNITGLLLTRDGGNNTETFETFRPGGGNMKDNWR
SELYKYKVVEVKPLGVAPTNARRRVVEREKRAVGMGAVFLGPLGAAGSTMGAASITLTVQARQLLSGIVQQQSNLLK
AIEAQQHMLKLTVWGIKQLQARVLALERYLKDQQLLGMWGCSGKLICTTNVYWNSSWSNKTYGDIWDNMTWMQWERE
ISNYTEIIYELLEESQNQQEKNEQDLLALDRWNSLWNWFNITNWLWYIKIFIMIVGGLIGLRIIFAVLSLVNRVRQG
YSPLSLQTLIPSPRGPDRPGGIEEEGGEQDRNRSTRLVSGFLALAWDDLRSLCLFIYHRLRDFILIAARAGELLGRS
SLKGLRRGWEALKYLGSLVQYWGLELKRSAISLLDTLAIAVGEGTDRILEFVLGICRAIRNIPTRIRQGFETALL*
>703010505.w78.35
MRVMGIQRNYPQWWINSMLGFWMLMICNGMWVTVYYGVPVWKEAKTTLFCASDAKAYEKEVHNVWATHACVPTDLNP
QEMVLKNVTENFNMWKNDMVDQMHEDVISLWDQSLKPCVKLTPLCVNATASNATASNSSILEGMKNCSFNITTELRD
KREKKNALFYKLDIVQLGGNSSQYRLINCNTSVITQACPKVSFDPIPIHYCAPAGYAILKCNNKTFNGTGPCNNVST
VQCTHGIKPVVSTQLLLNGSLAEGEIIIRSKNITDNGKTIIVHLNESVKIECTRPSNNTRTSIRIGPGQAFYATGQV
IGDIREAHCNISESKWNETLQRVSEKLKEYFPQKNITFQPSSGGDLEITTHSFNCGGEFFYCNTSSLFNETYMAIST
DMANSTETNSTRIITIRCRIKQIINMWQEVGRAMYAPPIAGNITCISNITGLLLTRDGGENNTETFETFRPGGGNMK
DNWRSELYKYKVVEVKPLGVAPTNARRRVVEREKRAVGMGAVFLGPLGAAGSTMGAASITLTVQARQLLSGIVQQQS
NLLKAKEAQQHMLKLTVWGIKQLQARVLALERYLKDQQLLGMWGCSGKLICTTNVYWNSSWSNKTYGDIWDNMTWMQ
WEREISNYTETIYELLEESQNQQEKNEQDLLALDRWNSLWNWFNITNWLWYIKIFIMIVGGLIGLRIIFAVLSLVNR
VRQGYSPLSLQTLIPSPRGPDRPGGIEEEGGEQDRNRSTRLVSGFLALAWDDLRSLCLFIYHRLRDFILIAARAGEL
```

FIG. 17A cont'd

```
LGRSSLKGLRRGWEALKYLGSLVQYWGLELKRSAISLLDTLAIAVGEGTDRILEFVLGICRAIRNIPTRIRQGFETA
LL*
>703010505.w78.3
MRVMGIQRNYTQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCINATNATASNSSILEGMKNCSFNITTE
LRDKREKKNALFYKLDIVQLGGNSSQYRLINCNTSVITQACPKVSFDPIPIHYCAPAGYAILKCNNKTFNGTGPCNN
VSTVQCTHGIKPVVSTQLLLNGSLAEGEIIIRSKNITDNGKIIIVHLNESVKIECTRPSNNTRTSIRIGPGQAFYAT
GQVIGDIREAHCNISESKWNETLQRVSKKLKEYFPDKNITFQPSSGGDLEITTHSFNCGGEFFYCNTSSLFNRTYMA
TSTDMANSTETNSTRIITIRCRIKQIINMWQEVGRAMYAPPIAGNITCISNITGLLLTRDGGENNTETFETFRPGGG
NMKDNWRSELYKYKVVEVKPLGVAPTNARRRVVEREKRAVGMGAVFLGFLGAAGSTMGAASITLTVQARQLLSGIVQ
QQSNLLKAIEAQQHMLKLTVWGIKQLQARVLALERYLKDQQLLGMWGCSGKLICTTNVYWNSSWSNKTYGDIWDNMT
WMQWEREISNYTELIYELLEESQNQQEKNEQDLLALDRWNSLWNWFNITNWLWYIKIFIMIVGGLIGLRIIFAVLSL
VNRVRQGYSPLSLQTLIPSPRGPDRPGGIEEEGGEQDRNRSTRLVSGFLALAWDDLRSLCLFIYHRLRDFILIAARA
GELLGRSSLKGLRRGWEALKYLGSLVQYWGLELKRSAISLLDTLAIAVGEGTDRILEFVLGICRAIRNIPTRIRQGF
ETALL*
>703010505.w78.23
MRVMGIQRNYTQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCINATNATASNSSILEGMKNCSFNITIE
LRDKREKKNALFYKLDIVQLGGNSSQYRLINCNTSVITQACPKVSFDPIPIHYCAPAGCAILKCNNKTFNGTGPCNN
VSTVQCTHGIKPVVSTQLLLNGSLAEGEIIIRSKNITDNGKTIIVHLNESVKIECTRPSNNTRTSIRIGPGQAFYAT
GQVIGDIREAHCNISESKWNETLQRVSKKLKEYFPDKNITFQPSSGGDLEITTHSFNCGGEFFYCNTSSLFNRTYMA
TSTDMANSTETNSTRIITIRCRIKQIINMWQEVGRAMYAPPIAGNITCISNITGLLLTRDGGENNTETFETFRPGGG
NMKDNWRSELYKYKVVEVKPLGVAPTNARRRVVEREKRAVGMGAVFLGFLGAAGSTMGAASITLTVQARQLLSGIVQ
QQSNLLKAIEAQQHMLKLTVWGIKQLQARVLALERYLKDQQLLGMWGCSGKLICTTNVYWNSSWSNKTYGDIWDNMT
WMQWEREISNYTELIYELLEESQNQQEKNEQDLLALDRWNSLWNWFNITNWLWYIKIFIMIVGGLIGLRIIFAVLSL
VNRVRQGYSPLSLQTLIPSPRGPDRPGGIEEEGGEQDRNRSTRLVSGFLALAWDDLRSLCLFIYHRLRDFILIAARA
GELLGRSSLKGLRRGWEALKYLGSLVQYWGLELKRSAISLLDTLAIAVGEGTDRILEFVLGICRAIRNIPTRIRQGF
ETALL*
>703010505.w78.17
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVTLDCINATNATASNSSILEGMKNCSFNITTE
LRDKREKKNALFYKLDIVQLGGNSSQYRLINCNTSVITQACPKVSFDPIPIHYCAPAGYAILKCNNKTFNGTGPCNN
VSTVQCTHGIKPVVSTQLLLNGSLAEGEIIIRSKNITDNGKTIIVHLNESVKIECTRPSNNTRTSIRIGPGQAFYAT
GQVIGDIREAHCNISESKWNETLQRVSKKLKEYFPDKNITFQPSSGGDLEITTHSFNCGGEFFYCNTSSLFNRTYMV
NSTDMANSTETNSTRFITIRCRIKQIINMWQEVGRAMYAPPIAGNITCISNITGLLLTRDGGENNTETFETFRPGGG
NMKDNWRSELYKYKVVEVKPLGVAPTNARRRVVEREKRAVGMGAVFLGFLGAAGSTMGAASITLTVQARQLLSGIVQ
QQSNLLKAIEAQQHMLKLTVWGIKQLQARVLALERYLKDQQLLGMWGCSGRLICTTNVYWNSSWSNKTYGDIWDNMT
WMQWEREISNYTELIYELLEESQNQQEKNEQDLLALDRWNSLWNWFNITNWLWYIKIFIMIVGGLIGLRIIFAVLSL
VNRVRQGYSPLSLQTLIPSPRGPDRPGGIEEEGGEQDRNRSTRLVSGFLALAWDDLRSLCLFIYHRLRDFILTAARA
GELLGRSSLKGLRRGWEALKYLGSLVQYWGLELKRSAISLLDTLAIAVGEGTDRILEFVLGICRAIRNIPTRIRQGF
ETALL*
>703010505.w78.31
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVRLTPLCVTLNCINATNATASNSSILEGMKNCSFNITTE
LRDKREKKNALFYKLDIVQLDGNSSQYRLINCNTSVIT*ACPKVSFDPIPIHYCAPAGYAILKCNNKTFNGTGPCNN
VSTVQCTHGIKPVVSTQLLLNGSLAEGEIIIRSKNITDNGKTIIVHLNESVKIECTRPSNNTRTSIRIGPGQAFYAT
GQVIGDIREAHCNISESKWNETLQRVSKKLKEYFPDKNITFQPSSGGDLEITTHSFNCGGEFFYCNTSSLFNRTYMA
TSTDMANSTETNSTRIITIRCRIKQIINMWQEVGRAMYAPPIAGNITCISNITGLLLTRDGGENNTETFETFRPGGG
NMKDNWRSELYKYKVVEVKPLGVAPTNARRRVVEREKRAVGMGAVFLGFLGAAGSTMGAASITLTVQARQLLSGIVQ
QQSNLLKAIEAQQHMLKLTVWGIKQLQARVLALERYLKDQQLLGMWGCSGKLICTTNVYWNSSWSNKTYGDIWDNMT
WMQWEKEISNYTELIYELLEESQNQQEKNEQDLLALDRWNSLWNWFNITNWLWYIKIFIMIVGGLIGLRIIFAALSL
VNRVRQGYSPLSLQTLIPSPRGPDRPGGIEEEGGEQDRNRSTRLVSGFLALAWDDLRSLCLFIYHRLRDFILIAARA
GELLGRSSLKGLRRGWEALKYLGSLVQYWGLELKRSAISLLDTLAIAVGEGTDRILEFVLGICRAIRNIPTRIRQGF
ETALL*
>703010505.w78.22
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVTLNCINATNATASNSSILEGMKNCSFNITTE
LRDKREKKNALFYKLDIVQLDGNSSQYRLINCNTSVITQACPKVSFDPIPIHYCAPAGYAILKCNNKTFNGTGPCNN
VSTVQCTHGIKPVVSTQLLLNGSLAEGEIIIRSKNITDNGKTIIVHLNESVKIECTRPSNNTRTSIRIGPGQAFYAT
GQVIGDIREAHCNISESKWNETLQRVSKKLKEYFPDKNITFQPSSGGDLEITTHSFNCGGEFFYCNTSSLFNRTYMA
TSTDMANSTETNSTRIITIRCRIKQIINMWQEVGRAMYAPPIAGNITCISNITGLLLTRDGGENNTETFETFRPGGG
NMKDNWRSELYKYKVVEVKPLGVAPTNARRRVVEREKRAVGMGAVFLGFLGAAGSTMGAASITLTVQARQLLSGIVQ
QQSNLLKAIEAQQHMLKLTVWGIKQLQARVLALERYLKDQQLLGMWGCSGKLICTTNVYWNSSWSNKTYGDIWDNMT
WMQWEREISNYTELIYELLEESQNQQEKNEQDLLALDRWNSLWNWFNITNWLWYIKIFIMIVGGLIGLRIIFAVLSL
VNRVRQGYSPLSLQTLIPSPRGPDRPGGIEEEGGEQDRNRSTRLVSGFLALAWDDLRSLCLFIYHRLRDFILIAARA
GELLGRSSLKGLRRGWEALKYLGSLVQYWGLELKRSAISLLDTLAIAVGEGTDRILEFVLGICRAIRNIPTRIRQGF
ETALL*
>703010505.w78.1
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVRLTPLCVTLNCINATNATASNNSILEGMKNCSFNIATE
```

FIG. 17A cont'd

```
LRDKREKKNALFYKLDIVQLDGNSSQYRLINCNTSVITQACPKVSFDPIPIHYCAPAGYAILKCNNKTFNGTGPCNN
VSTVQCTHGIKPVVSTQLLLNGSLAEGEIIIRSKNITDNGKTIIVHLNESVKIECTRPSNNTRTSIRIGPGQAFYAT
GQVIGNIREAHCNISESKWNETLQRVSKKLKEYFPDKNITFQPSSGGDLEITTHSFSCGGEFFYCNTSSLFNRTYMA
TNTTDMANSTETNSTRIITIRCRIRQIINMWQEVGRAMYAPPIAGNITCISNITGLLLTRDGGENNTETFETFRPGGG
NMKDNWRSELYKYKVVEVKPLGVAPTNARRRVVEREKRAVGMGAVFLGFLGAAGSTMGAASITLTVQARQLLSGIVQ
QQSNLLKAIEAQQHMLKLTVWGIKQLQARVLALERYLKDQQLLGMWGCSGKLICTTNVYWNSSWSNKTYGDIWDNMT
WNQWEREISNYTELIYELLEKSQNQQEKNEQDLLALDRWNSLWNWFNITNWLWYIKIFIMIVGGLIGLRIIFAVLSL
VNRVRQGYSPLSLQTLIPSPRGPDRPGGIEEEGGEQDRNRSTRLVSGFLALAWDDLRSLCLFIYHRLRDFILIAARA
GELLGRSSLKGLREGWEALKYLGSLVQYWGLELKRSAISLLDTLAIAVGEGTDRILEFVLGICRAIRNIPTRIRQGF
ETALL*
>703010505.w78.15
MRVMGIQRNYPQWWIWSMLGFWMLMICNGMWVTVYYGVPVWKEAKTTLFCASDAKAYEKEVHNVWATHACVPTDPNP
QEMVLKNVTENPNMWKNDMVDQMHEDVISLWDQSLKPCVKLTPLCVTLSCTNATNATASNSSILEGMKNCSFNITTE
LRDKREKKNALFYKLDIVQLDGNSSQYRLINCNTSVITQACPKVSFDPIPIHYCAPAGYAILKCNNKTFNGTGPCNN
VSTVQCTHGIKPVVSTQLLLNGSLAEGEIIIRSKNITDNGKTIIVHLNESVKIECTRPSNNTRTSIRIGPGQAFYAT
GQVIGDIREAHCNISESKWNETLQRVSEKLKEYFPEKNITFQPSSGGDLEITTHSFNCGGEFFYCNTSSLFNRTYMA
TSTDMANSTETNSTRIITIRCRIKQIINMWQEVGRAMYAPPIAGNITCISNITGLLLTRDGGKNDTDTFRPEGGNMK
DNWRSELYKYKVVEVKPLGVAPTNARRRVVEREKRAVGMGAVFLGFLGAAGSTMGAASITLTVQARQLLSGIVQQQS
NLLKAIEAQQHMLKLTVWGIKQLQARVLALERYLKDQQLLGMWGCSGKLICTTNVYWNSSWSNKTYGDIWDNMTWMQ
WEREISNYTELIYELLEESQNQQEKNEQDLLALDRWNSLWNWFNITNWLWYIKIFIMIVGGLIGLRIIFAVLSLVNR
VRQGYSPLSLQTLIPSPRGPDRPGGIEEEGGEQDRNRSTRLVSGFLALAWDDLRSLCLFIYHRLRDFILIAARAGEL
LGRSSLKGLRRGWEALKYLGNLVQYWGLELKRSAISLLDTLAIAVGEGTDRILEFVLGICRAIRNIPTRIRQGFETA
LL*
>703010505.w78.27
MRVMGIQRNYPQWWIWSMLGFWMLMICNGMWVTVYYGVPVWKEAKTTLFCASDAKAYEKEVHNVWATHACVPTDPNP
QEMVLKNVTENPNMWKNDMVDQMHEDVISLWDQSLKPCVKLTPLCVTLSCTNATNATASNSSILEGMKNCSFNITTE
LRDKREKKNALFYKLDIVQLDGNSSQYRLINCNTSVITQACPKVSFDPIPIHYCAPAGYAILKCNNKTFNGTGPCNN
VSTVQCTHGIKPVVSTQLLLNGSLAEGEIIIRSKNITDNGKTIIVHLNESVKIECTRPSNNTRTSIRIGPGQAFYAT
GQVIGDIREAHCNISESKWNETLQRVSEKLKEYFPEKNITFQPSSGGDLEITTHSFNCGGEFFYCNTSSLFNRTYMA
TSTDMANSTETNSTRIITIRCRIKQIINMWQEVGRAMYAPPIAGNITCISNITGLLLTRDGGKNDTDTETFRPEGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYGDIWDNMTW
MQWEREISNYTELIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEBGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w78.18
MRVMGIQRNYPQWWIWSMLGFWMLMICNGMWVTVYYGVPVWKEAKTTLFCASDAKAYEKEVHNVWATHACVPTDPNP
QEMVLKNVTENPNMWKNDMVDQMHEDVISLWEQSLKPCVKLTPLCVTLNCINATNATASNSSILEGMKNCSFNITTE
LRDKREKKNALFYKLDIVQLDGNSSQYRLINCNTSAITQACPKVSFDPIPIHYCAPAGYAILKCNNKTFNGTGPCNN
VSTVQCTHGIKPVVSTQLLLNGSLAEGEIIIRSKNITDNGKTIIVHLNESVKIECTRPSNNTRTSIRIGPGQAFYAT
GQVIGDIREAHCNISESKWNETLQRVSEKLKEYFPEKNITFQPSSGGDLEVTTHSFNCGGEFFYCNTSSLFNRTYMA
TSTDMANSTETNSTRIITIRCRIKQIINMWQEVGRAMYAPPIAGNITCISNITGLLLTRDGGKNDTDTETFRPEGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYGDIWDNMTW
MQWEREISNYTDIIYELLEESQNQQEKNEQDLLALDRWNSLWNWFNITNWLWYIKIFIMIVGGLIGLRIIFAVLSLV
NRVRQGYSPLSFQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w78.20
MRVMGIQRNYPQWWIWSMLGFWMLMICNGMWVTVYYGVPVWKEAKTTLFCASDAKAYEKEVHNVWATHACVPTDPNP
QEMVLKNVTENPNMWKNDMVDQMHEDVISLWDQSLKPCVKLTPLCVTLNCIDATASNATAINISIIEEMKNCSFNIT
TELRDKREKKNALFYKLDIVQLDGNSSQHRLINCNTSVITQACPKVSFDPIPIHYCAPAGYAILKCNNKTFNGTGPC
NNVSTVQCTHGIKPVVSTQLLLNGSLAEGEIIIRSKNITDNGKTIIVHLNESVKIECTRPSNNTRTSIRIGPGQAFY
ATGQVIGNIREAHCNISESKWNETLQRVSEKLKEYFPHKNITFQPSSGGDLEITTHSFNCGGEFFYCNTSSLFNRTY
MATSTDMANSTETNSTRIITIRCRIKQIINMWQEVGRAMYAPPIAGNITCISNITGLLLTRDGGKNDTDTETFRPEG
GNMKDNWRSELYKYKVVEVKPLGVAPTNARRRVVEREKRAVGMGAVFLGFLGAAGSTMGAASITLTVQARQLLSGIV
QQQSNLLKAIEAQQHMLKLTVWGIKQLQARVLALERYLKDQQLLGMWGCSGKLICTTNVYWNSSWSNKTYGDIWDNM
TWMQWEREISNYTDIIYELLEESQNQQEKNEQDLLALDRWNSLWNWFNITNWLWYIKIFIMIVGGLIGLRIIFAVLS
LVNRVRQGYSPLSLQTLIPSPRGPDRPGGIEEEGGEQDRNRSTRLVSGFLALVWDDLRSLCLFIYHRLRDFILIAAR
AGELLGRSSLKGLRRGWEALKYLGSLVQYWGLELKRSAISLLDTLAIAVGEGTDRILEFVLGICRAIRNIPTRIRQG
FETALL*
>703010505.w78.10
MRVMGIQRNYPQWWIWSMLGFWMLMICNGMWVTVYYGVPVWKEAKTTLFCASDAKAYEKEVHNVWATHACVPTDPNP
QEMVLKNVTENPNMWKNDMVDQMHEDVISLWDQSLKPCVKLTPLCVTLNCIDATASNATAINISIIEEMKNCSFNIT
TELRDKREKKNALFYKLDIVQLDGNSSQHRLINCNTSVITQACPKVSFDPIPIHYCAPAGYAILKCNNKTFNGTGPC
NNVSTVQCTHGIKPVVSTQLLLNGSLAEGEIIIRSKNITDNGKTIIVHLNESVKIECTRPSNNTRTSIRIGPGQAFY
ATGQVIGNIREAHCNISESKWNETLQRVSEKLKEYFPHKNITFQPSSGGDLEITTHSFNCGGEFFYCNTSSLFNRTY
MATSTDMANSTETNSTRIITIRCRIKQIINMWQEVGRAMYAPPIAGNITCISNITGLLLTRDGGKNDTDTETFRPEG
GNMKDNWRSELYKYKVVEVKPLGVAPTNARRRVVEREKRAVGMGAVFLGFLGAAGSTMGAASITLTVQARQLLSGIV
```

FIG. 17A cont'd

QQQSNLLKAIEAQQHMLKLTVWGIKQLQARVLALERYLKDQQLLGMWGCSGKLICTTNVYWNSSWSNKTYGDIWDNM
TWMQWEREISNYTDIIYELLEESQNQQEKNEQDLLALDRWNSLWNWFNITNWLWYIKIFIMIVGGLIGLRIIFAVLS
LVNRVRQGYSPLSLQTLIPSPRGPDRPGGIEEEGGEQDRNRSTRLVSGFLALVWDDLRSLCLFIYHRLRDFILIAAR
AGELLGRSSLKGLRRGWEALKYLGSLVQYWGLELKRSAISLLDTLAIAVGEGTDRILEFVLGICRAIRNIPTRIRQG
FETALL*
>703010505.w78.38
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCIDATASNATAINISIIEEMKNCSPNIT
TELRDKREKKNALFYKLDIVQLDGNSSQHRLINCNTSVITQACPKVSFDPIPIHYCAPAGYAILKCNNKTFNGTGPC
NNVSTVQCTHGIKPVVSTQLLLNGSLAEGEIIIRSKNITDNGKTIIVHLNESVKIECTRPSNNTRTSIRIGPGQAFY
ATGQVIGNIREAHCNISKSKWNETLQRVSEKLKEYFPHKNITPQPSSGGDLEITTHSFNCGGEFFYCNTSSLFNETY
MATSTDMANSTETNSTRIITIRCRIKQITNMWQEVGRAMYAPPIAGNITCISNITGLLLTRDGGKNDTDIETFRPEG
GNMKDNWRSELYKYKVVEVKPLGVAPTNARREVVEREKRAVGMGAVFLGFLGAAGSTMGAASITLTVQARQLLSGIV
QQQSNLLKAIEAQQHMLKLTVWGIKQLQARVLALERYLKDQQLLGMWGCSGKLICTTNVYWNSSWSNKTYGDIWDNM
TWMQWEREISNYTDIIYELLEESQNQQEKNEQDLLALDRWNSLWNWFNITNWLWYIKIFIMIVGGLIGLPIIFAVLS
LVNRVRQGYSPLSLQTLIPSPRGPDRPGGIEKEGGEQDRNRSTRLVSGFLALVWDDLRSLCLFIYHRLRDFILIAAR
AGELLGRSSLKGLRRGWEALKYLGSLVQYWGLELKRSAISLLDTLAIAVGEGTDRILEFVLGICRAIRNIPTRIRQG
FETALL*
>703010505.w78.43
MRVMGIQRNYPQWWIWSMLGFWMLMICNGMWVTVYYGVPVWKEAKTTLFCASDAKAYEKEVHNVWATHACVPTDPNP
QEMVLKNVTENFNMGKNDMVDQMHEDVISLWDQSLKPCVKLTPLCVTLNCTDANATASNSSIIEGMNSSILEGMKNC
SPNITTELRDKREKKNALFYKLDIVQLGGNSSQYRLINCNTSVITQACPKVSFDPIPIHYCAPAGYAILKCNNKTFN
GTGPCNNVSTVQCTHGIKPVVSTQLLLNGSLAEGEIIIRSKNITDNGKTIIVHLNESVKIECTRPSNNTRTSIRIGP
GQAFYATGQVIGDIREAHCNISESKWNETLQRVSEKLKEYFPHKNITFQPSSGGDLEITTHSFNCGGEFFYCNTSSL
FNRTYMATSTDMANSTETNSTRIITIRCRIKQIINMWQEVGRAMYAPPIAGNITCISNITGLLLTRDGGKNDTDTET
FRPEGGNMKDNWRSELYKYKVVEVKPLGVAPTNARRRVVEREKRAVGMGAVFLGFLGAAGSTMGAASITLTVQARQL
LSGIVQQQSNLLKAIEAQQHMLKLTVWGIKQLQARVLALERYLKDQQLLGMWGCSGKLICTTNVYWNSSWSNKTYGD
IWDNMTWMQWEREISNYTELIYELLEESQNQQEKNEQDLLALDRWNSLWNWFNITNWLWYIKIFIMIVGGLIGLRII
FAVLSLVNRVRQGYSPLSLQTLIPSPRGPDRPGGIEEEGGEQDRNRSTRLVSGFLALAWDDLRSLCLFIYERLRDFI
LIAARAGELLGRSSLKGLRRGWEALKYLGSLVQYWGLELKRSAISLLDTLAIAVGEGTDRILEFVLGICRAIRNIPT
RIRQGFETALL*
>703010505.w78.8
MRVMGIQRNYTQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNVNATASNSSIIEGMNSSILEGMKNC
SPNITTELRDKREKKNALFYKLDIVQLGGNSSQYRLINCNTSVITQACPKVSFDPIPIHYCAPAGYAILKCNNKTFN
GTGPCNNVSTVQCTHGIKPVVSTQLLLNGSLAEGEIIIRSKNITDNGKTIIVHLNESVKIECTRPSNNTRTSIRIGP
GQAFYATGQVIGDIREAHCNISESKWNETLQRVSEKLKEYFPDKNITFQPSSGGDLEITTHSFNCGGEFFYCNTSSL
FNRTYMANSTDMANSTETNSTRIITIRCRIKQIINMWQEVGRAMYAPPIAGNITCISNITGLLLTRDGGENNTETFE
TFRPGGGNMKDNWRSELYKYKVVEVKPLGVAPTNARRRVVEREKRAVGMGAVFLGFLGAAGSTMGAASITLTVQARQ
LLSGIVQQQSNLLKAIEAQQHMLKLTVWGIKQLQARVLALERYLKDQQLLGMWGCSGKLICTTNVYWNSSWSNKTYG
DIWDNMTWMQWEREISNYTELIYELLEESQNQQEKNEQDLLALDRWNSLWDWFNITNWLWYIKIFIMIVGGLIGLRI
IFAVLSLVNRVRQGYSPLSLQTLIPSPRGPDRPGGIEEEGGEQDRNRSTRLVSGFLALAWDDLRSLCLFIYHRLRDF
ILIAARAGELLGRSSLKGLRRGWEALKYLGSLVQYWGLELKRSAISLLDTLAIAVGEGTDRILEFVLGICRAIRNIP
TRIRQGFETALL*
>703010505.w78.14
MRVMGIQRNYTQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNVNATASNSSIIEGMNSSILEGMKNC
SPNITTELRDKREKKNALFYKLDIVQLGGNSSQYRLINCNTSVITQACPKVSFDPIPIHYCAPAGYAILKCNNKTFN
GTGPCNNVSTVQCTHGIKPVVSTQLLLNGSLAEGEIIIRSKNITDNGKTIIVHLNESVKIECTRPSNNTRTSIRIGP
GQAFYATGQVIGDIREAHCNISESKWNETLQRVSEKLKEYFPDKNITFQPSSGGDLEITTHSFNCGGEFFYCNTSSL
FNRTYMANSTDMANSTETNSTRIITIRCRIKQIINMWQEVGRAMYAPPIAGNITCISNITGLLLTRDGGENNTETFE
TFRPGGGNMKDNWRSELYKYKVVEVKPLGVAPTNARRRVVEREKRAVGMGAVFLGFLGAAGSTMGAASITLTVQARQ
LLSGIVQQQSNLLKAIEAQQHMLKLTVWGIKQLQARVLALERYLKDQQLLGMWGCSGKLICTTNVYWNSSWSNKTYG
DIWDNMTWMQWEREISNYTELIYELLEESQNQQEKNEQDLLALDRWNSLWDWFNITNWLWYIKIFIMIVGGLIGLRI
IFAVLSLVNRVRQGYSPLSLQTLIPSPRGPDRPGGIEEEGGEQDRNRSTRLVSGFLALAWDDLRSLCLFIYHRLRDF
ILIAARAGELLGRSSLKGLRRGWEALKYLGSLVQYWGLELKRSAISLLDTLAIAVGEGTDRILEFVLGICRAIRNIP
TRIRQGFETALL*
>703010505.w78.7
MRVMGIQRNYTQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTNVNATASNSSIIEGMNSSILEGMKNC
SPNITTELRDKREKKNALFYKLDIVQLGGNSSQYRLINCNTSVITQACPKVSFDPIPIHYCAPAGYAILKCNNKTFN
GTGPCNNVSTVQCTHGIKPVVSTQLLLNGSLAEGEIIIRSKNITDNGKTIIVHLNESVKIECTRPSNNTRTSIRIGP
GQAFYATGQVIGDIREAHCNISESKWNETLQRVSEKLKEYFPDKNITFQPSSGGDLEITTHSFNCGGEFFYCNTSSL
FNRTYMANSTDMANSTETNSTRIITIRCRIKQIINMWQEVGRAMYAPPIAGNITCISNITGLLLTRDGGENNTETFE
TFRPGGGNMKDNWRSELYKYKVVEVKPLGVAPTNARRRVVEREKRAVGMGAVFLGFLGAAGSTMGAASITLTVQARQ
LLSGIVQQQSNLLKAIEAQQHMLKLTVWGIKQLQARVLALERYLKDQQLLGMWGCSGKLICTTNVYWNSSWSNKTYG
DIWDNMTWMQWEREISNYTELIYELLEESQNQQEKNEQDLLALDRWNSLWDWFNITNWLWYIKIFIMIVGGLIGLRI
IFAVLSLVNRVRQGYSPLSLQTLIPSPRGPDRPGGIEEEGGEQDRNRSTRLVSGFLALAWDDLRSLCLFIYHRLRDF
ILIAARAGELLGRSSLKGLRRGWEALKYLGSLVQYWGLELKRSAISLLDTLAIAVGEGTDRILEFVLGICRAIRNIP
TRIRQGFETALL*

FIG. 17A cont'd

```
>703010505.w78.40
MRVMGRQRNYPQWWIWSMLGFWMLMICNGMWVTVYYGVPVWKEAKTTLFCASDAKAYEKEVHNVWATHACVPTDPNP
QEMVLKNVTEKFNMWKNDMVDQMHEDVISLWDQSLKPCVRLTPLCVTLNCTNVNATASNSSIIEGMNSSILEGMKNC
SFNITTELRDKREKKNALFYKLDIVQLDGNSSQYRLINCNTSVITQACPKVSFDPIPIHYCAPAGYAILKCNNKTFN
GTGPCNNVSTVQCTHGIKPVVSTQLLLNGSLAEGEIIIRSKNITDNGKTIIVHLNESVKIECTRPSNNTRTSIRIGP
GQAFYATGQVIGDIREAHCNISESKWNETLQRVSEKLKEYFPQKNITFQPSSGGDLEITTHSFNCGGEFFYCNTSSL
FNRTYMANSTDMANSTETNSTRIITIRCRIKQIINMWQEVGRAMYAPPIAGNITCISNITGLLLTRDGGENNTETFE
TFRPGGGNMKDNWRSELYKYKVVEVKPLGVAPTNARRRVVEREKRAVGMGAVFLGFLGAASGSTMGAASITLTVQARQ
LLSGIVQQQSNLLKAIEAQQHMLKLTVWGIKQLQARVLALERYLKDQQLLGMWGCSGKLICTTNVYWNSSWSNKTYG
DIWDNMTWMQWEREISNYTEKIYELLEESQNQQEKNEQDLLALDRWNSLWNWFNITNWLWYIKIFIMIVGGLIGLRI
IFAVLSLVNRVRQGYSPLSLQTLIPSPRGPDRPGGIEEEGGEQDRNRSTRLVSGFLALAWDDLRSLCLFIYHRLRDF
TLIAARAGELLGRSSLKGLWRGWEALKYLGSLVQYWGLELKRSAISLLDTLAIAVGEGTDRILEFVLGICRAIRNIP
TRIRQGFETALL*
>703010505.w100.C2
#RVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVRLTPLCVTLNCINATNATASKSSILEGMKNCSFNITTE
LRDKREKKNALFYKLDIVQLDGNSSQYRLINCNTSVITQACPKVSFDPIPIHYCAPAGYAILKCNNKTFNGTGPCNN
VSTVQCTEGIKPVVSTQLLLNGSLAEGEIIIRSKNITDNGKTIIVHLNESVKIECTRPSNNTRTSIRIGPGQAFYAT
GQVIGNIREAHCNISESKWNETLQRVSEKLKEYFPEKNITFQPSSGGDLEITTHSFNCGGEFFYCNTSSLFNRTYMV
NSTDMANSTETNSTRIITISCRIKQIINMWQEVGRAMYAPPIAGNITCISNITGLLLTRDGGNDTDTETFRPEGGNM
KDNWRSELYKYKVVEVKPLGVAPTNARRRVVEREKRAVGMGAVFLGFLGAASGSTMGAASITLTVQARQLLSGIVQQQ
SNLLKAIEAQQHMLKLTVWGIKQLQARVLALERYLKDQQLLGMWGCSGKLICTTNVYWNSSWSNKTYGDIWDNMTWM
QWEREISNYTEIIYELLEESQNQQEKNEQDLLALDRWNSLWNWFNITNWLWYIKIFIMIVGGLIGLRIIFAVLSLVN
RVRQGYSPLSLQTLIPSPRGPDRPGGIEEEGGEQDRNRSTRLVSGFLALAWDDLRSLCLFIYHRLRDFILIAARVGE
LLGRNSLKGLRRGWEALKYLGSLVQYWGLELKRSAISLLDTLAIAVGEGTDRILEFVLGICRAIRNIPTRIRQGFET
ALL*
>703010505.w100.T3
MRVRGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVRLTPLCVTLNCINATNATASNSSILEGMKNCSFNITTE
LRDKREKKNALFYKLDIVQLDGNSSQYRLINCNTSVITQACPKVSFDPIPIHYCAPAGYAILKCNNKTFNGTGPCNN
VSTVQCTHGIKPVVSTQLLLNGSLAEGEIIIRSKNITDNGKTIIVHLNESVKIECTRPSNNTRTSIRIGPGQAFYAT
GQVIGNIREAHCNISESKWNETLQRVSEKLKEYFPEKNITFQPSSGGDLEITTHSFNCGEFFYCNTSSLFNRTYMA
TSTDMANSTETNSTRIITIRCRIKQIINMWQEVGRAMYAPPIAGNITCISNITGLLLTRDGGENDTDTETFRPEGGN
MKDNWRSELYKYKVVEVKPLGVAPTNARRRVVEREKRAVGMGAVFLGFLGAASGSTMGAASITLTVQARQLLSGIVQQ
QSNLLKAIEAQQHMLKLTVWGIKQLQARVLALERYLKDQQLLGMWGCSGKLICTTNVYWNSSWSNKTYGDIWDNMTW
MQWEREISNYTELIYELLEESQNQQEKNEQDLLALDRWNSLWNWFNITNWLWYIKIFIMIVGGLIGLRIIFAVLSLV
NEVRQGYSPLSLQTLIPSPRGPDRPGGIEEEGGEQDRNRSTRLVSGFLALVWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w100.A6
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVRLTPLCVTLNCINATNATASNSSILEGMKNCSFNITTE
LRDKREKKNALFYKLDIVQLDGNSSQYRLINCNTSVITQACPKVSFDPIPIHYCAPAGYAILKCNNKTFNGTGPCNN
VSTVQCTHGIKPVVSTQLLLNGSLAEGEIIIRSKNITDNGKTIIVHLNESVKIECTRPSNNTRTSIRIGPGQAFYAT
GQVIGNIREAHCNISESKWNETLQRVSEKLKEYFPQKNITFQPSSGGDLEITTHSFNCGGEFFYCNTSSLFNRTYMA
TSTDMANSTETNSTRIITIRCRIKQIINMWQEVGRAMYAPPIAGNITCISNITGLLLTRDGGNDTDTETFRPEGGNM
KDNWRSELYKYKVVEVKPLGVAPTNARRRVVEREKRAVGMGAVFLGFLGAASGSTMGAASITLTVQARQLLSGIVQQQ
SNLLKAIEAQQHMLKLTVWGIKQLQARVLALERYLKDQQLLGMWGCSGKLICTTNVYWNSSWSNKTYGDIWDNMTWM
QWEREISNYTDIIYELLEESQNQQEKNEQDLLALDRWNSLWNWFNITNWLWYIKIFIMIVGGLIGLRIIFAVLSLVN
RVRQGYSPLSLQTLIPSPRGPDRPGGIEEEGGEQDRNRSTRLVSGFLALAWDDLRSLCLFIYHRLRDFILIAARAGE
LLGRSSLKGLRRGWEALKYLGSLVQYWGLELKRSAISLLDTLAIAVGEGTDRILEFVLGICRAIRNIPTRIRQGFET
ALL*
>703010505.w100.A12
MRVRGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVRLTPLCVTLNCINATNATASNSSILEGMKNCSFNITTE
LRDKREKKNALFYKLDIVQLDGNSSQYRLINCNTSVITQACPKVSFDPIPIHYCAPAGYAILKCNNKTFNGTGPCNN
VSTVQCTEGIKPVVSTQLLLNGSLAEGEIIIRSKNITDNGKTIIVHLNESVKIECTRPSNNTRTSIRIGPGQAFYAT
GQVIGDIREAHCNISESKWNETLQRVSEKLKEYFPDKNITFQPSSGGDLEITTHSFNCGGEFFYCNTSSLFNRTYMA
NSTDMANSTETNSTRIITLRCRIKQIINMWQEVGRAMYAPPIAGNITCISNITGLLLTRDGGNDIDTETFRPEGGNM
KDNWRSELYKYKVVEVKPLGVAPTNARRRVVEREKRAVGMGAVFLGFLGAASGSTMGAASITLTVQARQLLSGIVQQQ
SNLLKAIEAQQHMLKLTVWGIKQLQARVLALERYLKDQQLLGMWGCSGKLICTTNVYWNSSWSNKTYGDIWDNMTWM
QWEREISNYTDIIYELLEESQNQQEKNEQDLLALDRWNSLWNWFNITNWLWYIKIFIMIVGGLIGLRIIFAVLSLVN
RVRQGYSPLSLQTLIPSPRGPDRPGGIEEEGGEQDRNRSTRLVSGFLALAWDDLRSLCLFIYHRLRDFILIAARAGE
LLGRSSLKGLRRGWEALKYLGSLVQYWGLELKRSAISLLDTLAIAVGEGTDRILEFVLGICRAIRNIPTRIRQGFET
ALL*
>703010505.w100.C1
MRVRGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVRLTPLCVTLNCINATNATASNSNILEGMKNCSFNITTE
LRDKREKKNALFYKLDIVQLDGNSSQYRLINCNTSVITQACPKVSFDPIPIHYCAPAGYAILKCNNKTFNGTGPCNN
VSTVQCTEGIKPVVSTQLLLNGSLAEGEIIIRSKNITDNGKTIIVHLNESVKIECTRPSNNTRTSIRIGPGQAFYAT
```

FIG. 17A cont'd

```
GQVIGDIREAHCNISESKWNETLQRVSEKLKEYFPDKNITFQPSSGGDLEITTHSFNCGGEFFYCNTSSLFNRTYMA
NSTDMANSTETNSTRIITLHCRIKQIINMWQEVGRAMYAPPIAGNITCISNITGLLLTRDGGKNDTDTETFRPEGGN
MKDNWRSELYKYKVVEVKPLGVAPTNARRRVVEREKRAVGMGAVFLGLLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYGDIWDNMTW
MQWEREISNYTDIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRGWEALKYLGSLVQYWGLELKRSAISLLDTLAIAVGEGTDRILEFVLGICRAIRNIPTRIRQGFE
TALL*
>703010505.w100.A9
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVRLTPLCVTLNCINATNATASNSSILEGMKNCSFNITTE
LRDKREKKNALFYKLDIVQLDGNSSQYRLINCNTSVITQACPKVSFDPIPIHYCAPAGYAILKCNNKTFNGTGPCNN
VSTVQCTHEGIKPVVSTQLLLNGSLAEGEIIIRSKNITDNGKTIIVHLNESVKIECTRPSNNTRTSIRIGPGQAFYAT
GQVIGDIREAHCNISESKWNETLQRVSEKLKEYFPDKNITFQPSSGGDLEITTHSFNCGGEFFYCNTSSLFNRTYMA
TNTDMANSTETNSTRIITIRCRIKQIINMWQEVGRAMYAPPIAGNITCISNITGLLLTRDGG#NDTDTETFRPEGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYGDIWDNMTW
MQWEREISNYTDIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIPNIPTRIRQGFE
TALL*
>703010505.w100.A7
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVRLTPLCVTLNCINATNATASNSSILEGMKNCSFNITTE
LRDKREKKNALFYKLDIVQLDGNSSQYRLINCNTSVITQACPKVSFDPIPIHYCAPAGYAILKCNNKTFNGTGPCNN
VSTVQCTHEGIKPVVSTQLLLNGSLAEGEIIIRSKNITDNGKTIIVHLNESVKIECTRPSNNTRTSIRIGPGQAFYAT
GQVIGDIREAHCNISERKWNETLQRVSEKLKEYFPDKNITFQPSSGGDLEITTHSFNCGGEFFYCNTSSLFNRTYMV
NSTDMANSTETNSTRLITISCRIKQIINMWQEVGRAMYAPPIAGNITCISNITGLLLTRDGGKNDTDTETFRPEGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYGDIWDNMTW
MQWEREISNYTDIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNESTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w100.A4
MRVMGIQRSYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVRLTPLCVTLNCINATNATASNSSILEGMKNCSFNITTE
LRDKREKKNALFYKLDIVQLDGNSSQYRLINCNTSVITQACPKVSFDPIPIHYCAPAGYAILKCNNKTFNGTGPCNN
VSTVQCTHEGIKPVVSTQLLLNGSLAEGEIIIRSKNITDNGKTIIVHLNESVKIECTRPSNNTRTSIRIGPGQAFYAT
GQVIGDIREAHCNISESKWNETLQRVSEKLKEYFPDKNITFQPSSGGDLEITTHSFNCGGEFFYCNTSNLFNRTYMV
NSTDMANSTETNSTRTITISCRIKQIINMWQEVGRAMYAPPIAGNITCISNITGLLLTRDGGKNDTDTETFRPEGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYGDIWDNMTW
MQWEREISNYTDIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w100.B10
MRVMGRQRNYPQWWIWSMLGLWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVRLTPLCVTLNCINATNATASNSSILEGMKNCSFNITTE
LRDKREKKNALFYKLDIVQLDGNSSQYRLINCNTSVITQACPKVSFDPIPIHYCAPAGYAILKCNNKTFNGTGPCNN
VSTVQCTHEGIKPVVSTQLLLNGSLAEGEIIIRSKNITDNGKTIIVHLNESVKIECTRPSNNTRTSIRIGPGQAFYAT
GQVIGDIREAHCNISESKWNETLQRVSKKLKEYFPDKNITFQPSSGGDLEITTHSFNCGGEFFYCNTSSLFNRTYMV
NSTDMANSTETNSTRTITISCRIKQIINMWQEVGRAMYAPPIAGNITCISNITGLLLTRDGGKNDTDTETFRPEGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYGDIWDNMTW
MQWEREISNYTELIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w100.A10
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVRLTPLCVTLNCTDATNATASNSSILGGMKNCSFNITTE
LRDKREKKNALFYKLDIVQLDGNSSQYRLINCNTSAITQACPKVSFDPIPIHYCAPAGYAILKCNNKTFNGTGPCNN
VSTVQCTHEGIKPVVSTQLLLNGSLAEGEIIIRSKNITDNGKTIIVHLNESVKIECTRPSNNTRTSIRIGPGQAFYAT
GQVIGDIREAHCNISESKWNETLQRVSEKLKEYFPDKNITFQPSSGGDLEITTHSPNCGGEFFYCNTSSLFNETYMA
NSTDMANSTETNSTRIITIRCRIKQIINMWQEVGRAMYAPPIAGNITCISNITGLLLTRDGGKNDTDTETFRPEGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYGDIWDNMTW
MQWEREISNYTELIYELLEESQNQQEKNEQDLLALDRWNSLWNWFNITNWLWYIKIFIMIVGGLIGLRIIFAVLSLV
```

FIG. 17A cont'd

```
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w100.A3
MRVMGIQKNCPQWWIWSMLGLWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTDANATASNSSIIKGMNSSMIEEMKNC
SFNITTELRDKREKKNALFYKLDIVQLDGNSSQYRLINCNTSVITQACPKVSFDPIPIHYCAPAGYAILKCNNKTFN
GTGPCNNVSTVQCTHGIKPVVSTQLLLNGSLAEGEIIIRSKNITDNGKTIIVHLNESVKIECTRPSNNTPTSIRIGP
GQAFYATGQVIGDIREAHCNISESKWNETLQRVSKKLKEYPPQKDITFQPSSGGDLEITTHSFNCGGEFFYCNTSSL
FNRTYMATSTDMANSTETNSTRIITIRCRIKQIINMWQEVGRAMYAPPIAGNITCISNITGLLLTRDGGENDTDTET
FRPEGGNMKDNWRSELYKYKVVEVKPLGVAPTNARRRVVEREKRAVGMGAVFLGFLGAAGSTMGAASITLTVQARQL
LSGIVQQQSNLLKAIEAQQHMLKLTVWGTKQLQARVLALEYLKDQQLLGMWGCSGKLICTTNVYWNSSWSNKTYGD
IWDNMTWMQWEREISNYTDIIYELLEESQNQQEKNEQDLLALDRWNSLWNWFPNITNWLWYIKIFIMIVGGLIGLRII
FAVLSLVNRVRQGYSPLSLQTLIPSPRGPDRPGGIEEEGGEQDRNRSTRLVSGFLALAWDDLRSLCLFIYHRLKDFI
LIAARAGELLGRSSLKGLRRGWEALKYLGSLVQYWGLELKRSAISLLDTLAIAVGEGTDRILEFVLGICPAIRNIPT
RIRQGFETALL*
>703010505.w100.B8
MRVRGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCTDANATASNSSIIKGMNSSMIEEMKNC
SFNITTELRDKREKKNALPYKLDIVQLDGNSSQYRLINCNTSVITQACPKVSFDPIPIHYCAPAGYAILKCNNKTFN
GTGPCNEVSTVQCTHGIKPVVSTQLLLNGSLAEGEIIIRSKNITDNGKTIIVHLNESVKIECTRPSNNTPTSIRIGP
GQAFYATGQVIGDIREAHCNISESKWNETLQRVSEKLKEYPPDKNITFQPSSGGDLEITTHSFNCGGEFFYCNTSSL
FNRTYMANSTDMANSTETNSTRIITLHCRIKQIINMWQEVGRAMYAPPIAGNITCISNITGLLLTRDGGKNDTDTET
FRPVGGNMKDNWRSELYKYKVVEVKPLGVAPTKARRRVVEREKRAVGMGAVFLGFLGAAGSTMGAASITLTVQARQL
LSGIVQQQSNLLKAIEAQQHMLKLTVWGTKQLQARVLALERYLKDQQLLGMWGCSGKLICTTNVYWNSSWSNKTYGD
IWDNMTWMQWEREISNYTELIYELLEESQNQQEKNEQDLLALDRWNSLWNWFPNITNWLWYIKIFIMIVGGLIGLRII
FAVLSLVNRVRQGYSPLSLQTLIPSPRGPDRPGGIEEEGGEQDRNRSTRLVSGFLALAWDDLRSLCLFIYHRLRDFI
LIAARAGELLGRSSLKGLRRGWEALKYLGSLVQYWGLELKRSAISLLDTLAIAVGEGTDRILEFVLGICRAIRNIPT
RIRQGFETALL*
>703010505.w100.B2
MRVMGIQRNYPQWWIWSMLGLWMLMICNGMWVTVYYGVPVWKKAKTTLFCASDAKAYEKEVHSVWATHACVPTDPNP
QEMVLKNVTENFNMWKNDMVDQMHEDVISLWDQSLKPCVKLTPLCVTLNCTDANATASNSSIIKGMNSSMIEEMKNC
SFNITTELRDKREKKNALFYKLDIVQLDGNSSQYRLINCNTSVITQACPKVSFDPIPIHYCAPAGYAILKCNNKTFN
GTGPCNNVSTVQCTHGIKPVVSTQLLLNGSLAEGEIIIRSENITNSAKTIIVHLNESVKIECTRPSNNTRTSIRIGP
GQAFYATGQVIGDIRKAHCNISESKWNETLQRVSKKLKEYPPDRNITFQPSSGGDPEITTHSFNCGGKFFYCNTSSL
FNRTYMANSTDMANSTETNSTRIITIRCRIKQIINMWQEVGRAMYAPPIAGNITCISNITGLLLTRDGGNNNTETFR
PVGGNMKDNWRSKLYKYKVVEVKPLGVAPTKARRRMVEREKRAVGMGAVPLGFLGAAGSTMGAASITLTVQARQLLS
GIVQQQSNLLKAIEAQQHMLKLTVWGIKQLQARVLALERYLKDQQLLGMWGCSGKLICTTNVYWNSSWSNKTYGDIW
DNMTWMQWEREISNYTEIIYDLLEESQNQQEKNEQDLLALDRWNSLWNWFNITKWLWYIKIFIMIVGGLIGLKIIFA
VLSLVNRVRQGYSPLSLQTLIPSPRGPDRPGGIEEEGGEQDRNRSTRLVSGFLALAWDDLRSLCLFIYHRLRDFILI
AARAGELLGRSSLKGLRRGWEALKYLEGLVQYWGLELKRSAISLLDTLAIAVGEGTDRILEFVLGICRAIRNIPTRI
RQGFETALL*
>703010505.w100.B4
MRVMGRQRNYPQWWIWSMLGLWMLMICNGMWVTVYYGVPVWKEAKTTLFCASDAKAYEKEVHNVWATHACVPTDPNP
QEMVLKNVTENFNMWENDMVDQMHEDVISLWDQSLKPCVKLTPLCVTLNCTDANATASNTNATASNINATASKNSII
EEMKNCSFNITTELRDKREKKYALFYKLDIVQLDGNSSQYRLINCNTSVITQACPKVSFDPIPIHYCAPAGYAILKC
NNKTFNGTGPCNNVSTVQCTHGIKPVVSTQLLLNGSLAEGEIIIRSKNITDNGKTIIVHLNESVKIECTRPSNNTET
SIRIGPGQAFYATGQVIGDIREAHCNISESKWNETLQRVSKKLKEYFPDKNITFQSSSGGDPEITTHSFNCGGEFFY
CNTSSLFNRTYMANSTDMANSTETNSTRIITIRCRIKQIINMWQEVGRAMYAPPIAGNITCISNITGLLLTRDGGNS
STETFRPEGGNMKDNWRSELYKYKVVEVKPLGVAPTNARRRVVEREKRAVGMGAVFLGFLGAAGSTMGAASITLTVQ
ARQLLSGIVQQQSNLLKAIEAQQHMLKLTVWGIKQLQARVLALERYLKDQQLLGMWGCSGKLICTTNVYWNSSWSNK
TYDDIWDNMTWMQWEREISNYTEMIYDLLEESQNQQEKNEQDLLALDRWNSLWNWFNITKWLWYIKIFIMIVGGLIG
LRIIFAVLSLVNRVRQGYSPLSLQTLIPSPRGPDRPGGIEEEGGEQDRKRSTELVSGFLALVWDDLRSLCLFIYHRL
RDFILIAARAGELLGRSSLKGLRRGWEALKYLGSLVQYWGLELKRSAISLLDTLAIAVGEGTDRILEFVLGICRAIR
NIPTRIRQGFETALL*
>703010505.w100.C7
MRVMGIQRNYPQWWIWSMLGLWMLMTCNGMWVTVYYGVPVWKEAKTTLFCASDAKAYEKEVHNVWATHACVPTDPNP
QEMVLKNVTENFNMWENDMVDQMHEDVISLWDQSLKPCVKLTPLCVTLNCTDANATASNTNATASNINATASKSSII
EEMKNCSFNITTELRDKREKKYALFYKLDIVQLDGNSSQYRLINCNTSVITQACPKVSFDPIPIHYCAPAGYAILKC
NNKTFNGTGPCNNVSTVQCTHGIKPVVSTQLLLNGSLAEGEIIIRSKNITDNGKTIIVHLNESVKIECTRPSNNTRT
SIRIGPGQAFYATGQVIGDIREAHCNISESKWNETLQRVSKKLKEYFPDKNITFQSSSGGDPEITTHSFNCGGEFFY
CNTSSLFNRTYMANSTDMANSTETNSTRIITIRCRIKQIINMWQEVGRAMYAPPIAGNITCISNITGLLLTRDGGEN
NGGKNNTETFRPGGGNMKDNWRSELYKYKVVEVKPLGVAPTKARRRVVEREKRAVGMGAVFLGFLGAAGSTMGAASI
TLTVQARQLLSGIVQQQSNLLKAIEAQQHMLKLTVWGIKQLQARVLALERYLKDQQLLGMWGCSGKLICTTNVYWNS
SWSNKTYGDIWDNMTWMQWEREISNYTDIIYDLLEESQNQQEKNEQDLLALDRWNSLWNWFNITKWLWYIKIFIMIV
GGLIGLRIIFAVLSLVNRVRQGYSPLSLQTLIPSPRGPDRPGGIEEEGGEQDRNRSTRLVSGFLALAWDDLRSLCLF
IYHRLRDFILIAARAGELLGRSSLKGLRRGWEALKYLGGLVQYWGLELKRSAISLLDTLAIAVGEGTDRILEFVLGI
CRAIRNIPTRIRQGFETALL*
>703010505.w100.T2
```

FIG. 17A cont'd

MRVMGIQRNYPQWWIWSMLGLWMLMICNGMWVTVYYGVPVWKEAKTTLFCASDAKAYEKEVHNVWATHACVPTDPNP
QEMVLKNVTENFNMWENDMVDQMHEDVISLWDQSLKPCVKLTPLCVTLNCTDANATASNINATTSKSSIIEEMKNCS
FNITTELRDKREKKYALFYKLDIVQLDGNSSQYRLINCNTSVITQAWPKVSFDPIPIHYCAPAGYAILKCNNKTFNG
TGPCNNVSTVQCTHGIKPVVSTQLLLNGSLAEGEIIIRPKNITDNGKTIIVHLNESVKIECTRPSNNTRTSIRIGPG
QAFYATGQVIGDIREAHCNISESKWNETLQRVSKKLKEYFPDKNITFQSSSGGDPEITTHSFNCGGEFFYCNTSSLF
NRTDMANSTETNSTRIITIRCRIKQIINMWQEVGRAMYAPPIAGNITCISNITGLLLTRDGGERNNGGKNNTETFRPG
GGNMKDNWRSELYKYKVVEVKPLGVAPTKARRRVVEREKRAVGMGAVFLGFLGAAGSTMGAASITLTVQARQLLSGI
VQQQSNLLKAIEAQQHMLKLTVWGIKQLQARVLALERYLKDQQLLGMWGCSGKLICTTNVYWNSSWSNKTYGDIWDN
MTWMQWEREISNYTDIIYDLLEESQNQQEKNEQDLLALDRWNSLWNWFNITKWLWYIKIFIMIVGGLIGLRIIFAVL
SLVNRVRQGYSPLSLQTLIPSPRGPDRPGGIEEEGGEQDRNRSTRLVSGFLALAWDDLRSLCLFIYHRLRDFILIAA
RAGELLGRSSLKGLRRGWEALKYLGGLVQYWGLELKRSAISLLDTLAIAVGEGTDRILEFVLGICRAIRNIPTRIRQ
GFETALL*
>703010505.w100.b7
RVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMADQMHEDVISLWDQSLKPCVKLTPLCVTLNCTDANATASNINATASKSSIIEEMKNCS
FNITTELRDKREKKYALFYKLDIVQLDGNSSQYRLINCNTSVITQACPKVSFDPIPIHYCAPAGYAILKCNNKTFNG
TGPCNNVSTVQCTHGIKPVVSTQLLLNGSLAEGEIIRSENITDNSKTIIVHLNESVKIECTRPSNNTRTSIRIGPG
QAFYATGQVIGDIREAHCNISESKWNETLQRVSKKLKEYFPDKNITFQPSSGGDPEITTHSFNCGGEFFYCNTSSLF
NRTYMANSTETNSTRTITLHCRIKQIINMWQEVGRAMYAPPIAGNITCISNITGLLLTRDGGENTRDGGNNNTETFR
PEGGNMKDNWRSELYKYKVVEVKPLGVAPTKARRRVVEREKRAVGMGAVFLGFLGAAGSTMGAASITLTVQARQLLS
GIVQQQSNLLKAIEAQQHMLKLTVWGIKQLQARVLALERYLKDQQLLGMWGCSGKLICTTNVYWNSSWSNKTYGDIW
DNMTWMQWEREISNYTDIIYELLEESQNQQEKNEQDLLALDRWNSLWNWFNITNWLWYIKIFIMIVGGLIGLRIIFA
VLSLVNRVRQGYSPLSLQTLIPSPRGPDRPGGIEEEBGGEQDRNRSTRLVSGFLALAWDDLRSLCLFIYHRLRDFILI
AARAGELLGRSSLKGLRRGWEALKYLGSLVQYWGLELKRSAISLLDTLAIAVGEGTDRILEFVLGICRAIRNIPTRI
RQGFETALL*
>703010505.w100.A11
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMADQMHEDVISLWDQSLKPCVKLTPLCVTLNCTDANATASNINATASKSSIIEEMKNCS
FNITTELRDKREKKYALFYKLDIVQLDGNSSQYRLINCNTSVITQACPKVSFDPIPIHYCAPAGYAILKCNNKTFNG
TGPCNNVSTVQCTHGIKPVVSTQLLLNGSLAEGEIIRSENITDNSKTIIVHLNESVKIECTRPSNNTRTSIRIGPG
QAFYATGQVIGDIREAHCNISESKWNETLQRVSKKLKEYFPDKNITFQPSSGGDPEITTHSFNCGGEFFYCNTSSLF
NRTYMANSTETNSTRTITLHCRIKQIINMWQEVGRAMYAPPIAGNITCISNITGLLLTRDGGENTRDGGNNNTETFR
PEGGNMKDNWRSELYKYKVVEVKPLGVAPTKARRRVVEREKRAVGMGAVFLGFLGAAGSTMGAASITLTVQARQLLS
GIVQQQSNLLKAIEAQQHMLKLTVWGIKQLQARVLALERYLKDQQLLGMWGCSGKLICTTNVYWNSSWSNKTYGDIW
DNMTWMQWEREISNYTDIIYELLEESQNQQEKNEQDLLALDRWNSLWNWFNITNWLWYIKIFIMIVGGLIGLRIIFA
VLSLVNRVRQGYSPLSLQTLIPSPRGPDRPGGIEEEGGEQDRNRSTRLVSGFLALAWDDLRSLCLFIYHRLRDFILI
AARAGELLGRSSLKGLRRGWEALKYLGSLVQYWGLELKRSAISLLDTLAIAVGEGTDRILEFVLGICRAIRNIPTRI
RQGFETALL*
>703010505.w100.B5
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMADQMHEDVISLWDQSLKPCVKLTPLCVTLNCTDANATASNINATASKSSII
EEMKNCSFNITTELRDKRE#KKYALFYKLDIVQLDGNSSQYRLINCNTSVITQACPKVSFDPIPIHYCAPAGYAILK
CNNKTFNGTGPCNNVSTVQCTHGIKPVVSTQLLLNGSLAEGEIIRSENITDNSKTIIVHLNESVKIECTRPSNNTR
TSIRIGPGQAFYATGQVIGDIREAHCNISESKWNETLQRVSKKLKEYFPDKNITFQPSSGGDPEITTHSFNCGGEFF
YCNTSSLFNRTYMANSTETNSTRTITLHCRIKQIINMWQEVGRAMYAPPIAGNITCISNITGLLLTRDGGENTRDGG
NNNTEFRPEGGNMKDNWRSELYKYKVVEVKPLGVAPTKARRRVVEREKRAVGMGAVFLGFLGAAGSTMGAASITLT
VQARQLLSGIVQQQSNLLKAIEAQQHMLKLTVWGIKQLQARVLALERYLKDQQLLGMWGCSGKLICTTNVYWNSSWS
NKTYGDIWDNMTWMQWEREISNYTDIIYELLEESQNQQEKNEQDLLALDRWNSLWNWFNITNWLWYIKIFIMIVGGL
IGLRIIFAVLSLVNRVRQGYSPLSLQTLIPSPRGPDRPGGIEEEGGEQDRNRSTRLVSGFLALAWDDLRSLCLFIYH
RLRDFILIAARAGELLGRSSLKGLRRGWEALKYLGSLVQYWGLELKRSAISLLDTLAIAVGEGTDRILEFVLGICRA
IRNIPTRIRQGFETALL*
>703010505.w100.C3
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMADQMHEDVISLWDQSLKPCVKLTPLCVTLNCTDANATASNTNATASNINATASKSSII
EEMKNCSFNITTELRDKREKKYALFYKLDIVQLDGNSSQYRLINCNTSVITQACPKVSFDPIPIHYCAPAGYAILKC
NNKTFNGTGPCNNVSTVQCTHGIKPVVSTQLLLNGSLAEGEIIRSENITDNSKTIIVHLNESVKIECTRPSNNTRT
SIRIGPGQAFYATGQVIGDIREAHCNISESKWNETLQRVSKKLKEYFPDKNITFQPSSGGDPEITTHSFNCGGEFFY
CNTSSLFNRTYMANSTETNSTRTITLHCRIKQIINMWQEVGRAMYAPPIAGNITCISNITGLLLTRDGGENTRDGGN
NNTETFRPEGGNMKDNWRSELYKYKVVEVKPLGVAPTKARRRVVEREKRAVGMGAVFLGFLGAAGSTMGAASITLTV
QARQLLSGIVQQQSNLLKAIEAQQHMLKLTVWGIKQLQARVLALERYLKDQQLLGMWGCSGKLICTTNVYWNSSWSN
KTYGDIWDNMTWMQWEREISNYTDIIYELLEESQNQQEKNEQDLLALDRWNSLWNWFNITNWLWYIKIFIMIVGGLI
GLRIIFAVLSLVNRVRQGYSPLSLQTLIPSPRGPDRPGGIEEEEGGEQDRNRSTRLVSGFLALAWDDLRSLCLFIYHR
LRDFILIAARAGELLGRSSLKGLRRGWEALKYLGSLVQYWGLELKRSAISLLDTLAIAVGEGTDRILEFVLGICRAI
RNIPTRIRQGFETALL*
>703010505.w100.B3
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMADQMHEDVISLWDQSLKPCVKLTPLCVTLNCTDANATASNTNATASNINATASKSSII
EEMKNCSFNITTELRDKREKKYALFYKLDIVQLDGNSSQYRLINCNTSVITQACPKVSFDPIPIHYCAPAGYAILKC
NNKTFNGTGPCNNVSTVQCTHGIKPVVSTQLLLNGSLAEGEIIRSENITDNSKTIIVHLNESVKIECTRPSNNTRT
SIRIGPGQAFYATGQVIGDIREAHCNISESKWNETLQRVSKKLKEYFPDKNITFQPSSGGDPEITTHSFNCGGEFFY

FIG. 17A cont'd

```
CNTSSLFNRTYMANSTETNSTRTITLHCRIKQIINMWQEVGRAMYAPPIAGNITCISNITGLLLTRDGGENTRDGGN
NNTETFRPEGGNMKDNWRSELYKYKVVEVKPLGVAPTKARRRVVEREKRAVGMGAVFLGFLGAAGSTMGAASITLTV
QARQLLSGIVQQQSNLLKAIEAQQHMLKLTVWGIKQLQARVLALERYLKDQQLLGMWGCSGKLICTTNVYWNSSWSN
KTYGDIWDNMTWMQWEREISNYTDIIYELLEESQNQQEKNEQDLLALDRWNSLWNWFNITNWLWYIKIFIMIVGGLI
GLRIIFAVLSLVNRVRQGYSPLSLQTLIPSPRGPDRPGGIEEEGGEQDRNRSTRLVSGFLALAWDDLRSLCLFIYHR
LRDFILIAARAGELLGRSSLKGLRRGWEALKYLGSLVQYWGLELKRSAISLLDTLAIAVGEGTDRILEFVLGICRAI
RNIPTRIRQGFETALL*
>703010505.w100.A5
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMADQMHEDVISLWDQSLKPCVKLTPLCVTLNCTDANATASNTNATASNINATASKSSII
EEMKNCSFNITTELRDKREKKYALFYKLDIVQLDGNSSQYRLINCNTSVITQACPKVSFDPIPIHYCAPAGYAILKC
NNKTFNGTGPCNNVSTVQCTHGIKPVVSTQLLLNGSLAEGEIIIRSENITDNSKTIIVHLNESVKIECTRPSNNTRT
SIRIGPGQAFYATGQVIGDIREAHCNISESKWNETLQRVSKKLKEYFPDKNITFQPSSGGDPEITTHSFNCGGEFFY
CNTSSLFNRTYMANSTETNSTRTITLHCRIKQIINMWQEVGRAMYAPPIAGNITCISNITGLLLTRDGGENTRDGGN
NNTETFRPEGGNMKDNWRSELYKYKVVEVKPLGVAPTKARRRVVEREKRAVGMGAVFLGFLGAAGSTMGAASITLTV
QARQLLSGIVQQQSNLLKAIEAQQHMLKLTVWGIKQLQARVLALERYLKDQQLLGMWGCSGKLICTTNVYWNSSWSN
KTYGDIWDNMTWMQWEREISNYTDIIYELLEESQNQQEKNEQDLLALDRWNSLWNWFNITNWLWYIKIFIMIVGGLI
GLRIIFAVLSLVNRVRQGYSPLSLQTLIPSPRGPDRPGGIEEEGGEQDRNRSTRLVSGFLALAWDDLRSLCLFIYHR
LRDFILIAARAGELLGRSSLKGLRRGWEALKYLGSLVQYWGLELKRSAISLLDTLAIAVGEGTDRILEFVLGICRAI
RNIPTRIRQGFETALL*
>703010505.w100.A2
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMADQMHEDVISLWDQSLKPCVKLTPLCVTLNCTDANATASNTNATASNINATASKSSII
EEMKNCSFNITTELRDKREKKYALFYKLDIVQLDGNSSQYRLINCNTSVITQACPKVSFDPIPIHYCAPAGYAILKC
NNKTFNGTGPCNNVSTVQCTHGIKPVVSTQLLLNGSLAEGEIIIRSENITDNSKTIIVHLNESVKIECTRPSNNTRT
SIRIGPGQAFYATGQVIGDIREAHCNISESKWNETLQRVSKKLKEYFPDKNITFQPSSGGDPEITTHSFNCGGEFFY
CNTSSLFNRTYMANSTETNSTRTITLHCRIKQIINMWQEVGRAMYAPPIAGNITCISNITGLLLTRDGGENTRDGGN
NNTETFRPEGGNMKDNWRSELYKYKVVEVKPLGVAPTKARRRVVEREKRAVGMGAVFLGFLGAAGSTMGAASITLTV
QARQLLSGIVQQQSNLLKAIEAQQHMLKLTVWGIKQLQARVLALERYLKDQQLLGMWGCSGKLICTTNVYWNSSWSN
KTYGDIWDNMTWMQWEREISNYTDIIYELLEESQNQQEKNEQDLLALDRWNSLWNWFNITNWLWYIKIFIMIVGGLI
GLRIIFAVLSLVNRVRQGYSPLSLQTLIPSPRGPDRPGRIEEEGGEQDRNRSTRLVSGFLALAWDDLRSLCLFIYHR
LRDFILIAARAGELLGRSSLKGLRRGWEALKYLGSLVQYWGLELKRSAISLLDTLAIAVGEGTDRILEFVLGICRAI
RNIPTRIRQGFETALL*
>703010505.w100.C4
MRVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMADQMHEDVISLWDQSLKPCVKLTPLCVTLNCTDANATASNTNATASNINATASKSSII
EEMKNCSFNITTELRDKREKKYALFYKLDIVQLDGNSSQYRLINCNTSVITQACPKVSFDPIPIHYCAPAGYAILKC
NNKTFNGTGPCNNVSTVQCTHGIKPVVSTQLLLNGSLAEGEIIIRSENITDNSKTIIVHLNESVKIECTRPSNNTRT
SIRIGPGQAFYATGQVIGDIREAHCNISESKWNETLQRVSKKLKEYFPDKNITFQPSSGGDPEITTHSFNCGGEFFY
CNTSSLFNRTYMANSTETNSTRTITLHCRIKQIINMWQEVGRAMYAPPIAGNITCISNITGLLLTRDGGENTRDGGN
NNTETFRPEGGNMKDNWRSELYKYKVVEVKPLGVAPTKARRRVVEREKRAVGMGAVFLGFLGAAGSTMGAASITLTV
QARQLLSGIVQQQSNLLKAIEAQQHMLKLTVWGIKQLQARVLALERYLKDQQLLGMWGCSGKLICTTNVYWNSSWSN
KTYGDIWDNMTWMQWEREISNYTDIIYELLEESQNQQEKNEQDLLALDRWNSLWNWFNITNWLWYIKIFIMIVGGLI
GLRIIFAVLSLVNRVRQGYSPLSLQTLIPSPRGPDRPGGIEEEGGEQDRNRSTRLVSGFLALAWDDLRSLCLFIYHR
LRDFILIAARAGELLGRSSLKGLRRGWEALKYLESLVQYWGLELKRSAISLLDTLAIAVGEGTDRILEFVLGICRAI
RNIPTRIRQGFETALL*
>703010505.w100.B6
MKVRGIQRNYPQWWIWSMLGLWMLMICNGMWVTVYYGVPVWKEAKTTLFCASDAKAYEKEVHNVWATHACVPTDPNP
QEMVLENVTENFNMWKNDMADQMHEDVISLWDQSLKPCVKLTPLCVTLNCTDANATASNTNATASNINATASKSSII
EEMKNCSFNITTELRDKREKKYALFYKLDIVQLDGNSSQYRLINCNTSVITQACPKVSFDPIPIHYCAPAGYAILKC
NNKTFNGTGPCNNVSTVQCTHGIKPVVSTQLLLNGSLAEGEIIIRSENITDNSKTIIVHLNESVKIECTRPSNNTRT
SIRIGPGQAFYATGQVIGDIREAHCNISESKWNETLQRVSKKLKEYFPDKNITFQPSSGGDPEITTHSFNCGGEFFY
CNTSSLFNRTYMANSTETNSTRTITLHCRIKQIINMWQBVGRAMYAPPIAGNITCISNITGLLLTRDGGENTRDGGN
NNTETFRPEGGNMKDNWRSELYKYKVVEVKPLGVAPTKARRRVVEREKRAVGMGAVFLGFLGAAGSTMGAASITLTV
QARQLLSGIVQQQSNLLKAIEAQQHMLKLTVWGIKQLQARVLALERYLKDQQLLGMWGCSGKLICTTNVYWNSSWSN
KTYGDIWDNMTWMQWEREISNYTDIIYDLLEESQNQQEKNEQDLLALDRWNSLWNWFNITKWLWYIKIFIMIVGGLI
GLRIIFAVLSLVNRVRQGYSPLSLQTLIPSPRGPDRPGGIEEEGGEQDRNRSTRLVSGFLALAWDDLRSLCLFIYHR
LRDFILIAARAGELLGRSSLKGLRRGWEALKYLGGLVQYWGLELKRSAISLLDTLAIAVGEGTDRILEFVLGICRAI
RNIPTRIRQGFETALL*
>703010505.w100.A13
MRVMGIQRNYPQWWIWSMLGLWMLMICNGMWVTVYYGVPVWKEAKTTLFCASDAKAYEKEAHNVWATHACVPTDPNP
QEMVLKNVTENFNMWKNDMADQMHEDVISLWDQSLKPCVKLTPLCVTLNCTDANATASNANATASNTNATVSNSSII
EEMKNCSFNITTELRDKREKKYALFYKLDIVQLDGNSSQYRLINCNTSVITQACPKVSFDPIPIHYCAPAGYAILKC
NNKTFNGTGPCNNVSTVQCTHGIKPVVSTQLLLNGSLAEGEIIIRSENITNSAKTIIVHLNESVKIECTRPSNNTRT
SIRIGPGQAFYATGQVIGDIRKAHCNISESKWNETLQRVSKKLKEYFPRKNITPQPSSGGDPEITTHSFNCGGEFFY
CNTSSLFNRTYMANSTETNSTRTITLHCRIKQIINMWQEVGRAMYAPPIAGNITCISNITGLLLTRDGGENTRDGGN
NNTETFRPGGGNMKDNWRSELYKYKVVEVKPLGVAPTNARRRVVEREKRAVGMGAVFLGFLGAAGSTMGAASITLTV
QARQLLSGIVQQQSNLLKAIEAQQHMLKLTVWGIKQLQARVLALERYLKDQQLLGMWGCSGKLICTTNVYWNSSWSN
KTYGDIWDNMTWMQWEREISNYTDIIYDLLEESQNQQEKNEQDLLALDRWNSLWNWFNITKWLWYIKIFIMIVGGLI
GLRIIFAVLSLVNRVRQGYSPLSLQTLIPSPRGPDRPGGIEEEGGEQDRNRSTRLVSGFLALAWDDLRSLCLFIYHR
```

FIG. 17A cont'd

```
LRDFILIAARAGELLGRSSLKGLRRGWEALKYLGGLVQYWGLELKRSAISLLDTLAIAVGEGTDRILEFVLGICRAI
RNIPTRIRQGFETALL*
>703010505.w100.B9
MRVMGIQRNYPQWWIWSMLGLWMLMICNGMWVTVYYGVPVWKEAKTTLFCASDAKAYEKEAHNVWATHACVPTDPNP
QEMVLKNVTENFNMWKNDMVDQMHEDVISLWDQSLKPCVKLTPLCVTLNCTDANATASNANATASNTNAIVSNSSII
EEMKNCSFNITTELRDKREKKYALFYKLDIVQLDGNSSQYRLINCNTSVITQACPKVSFDPIPIHYCAPAGYAILEC
NNKTFNGTGPCNNVSTVQCTHGIKPVVSTQLLLNGSLAEGEIIIRSENITNSAKTIIVHLNESVKIECTRPSNNTRT
SIRIGPGQAFYATGQVIGDIRKAHCNISESKWNETLQRVSKKLKEYFPPKNITFQPSSGGDPEITTHSFNCGGEFFY
CNTSSLFNRTYMANSTETNSTRTITLHCRIKQIINMWQEVGRAMYAPPIAGNITCISNITGLLLTRDGGENTRDGGN
KNTETPRPGGGNMKDNWRSELYKYKVVEVKPLGVAPTKARRRVVEREKRAVGMGAVPLGFLGAAGSTMGAASITLTV
QARQLLSGIVQQQSNLLKAIEAQQHMLKLTVWGIKQLQARVLALERYLKDQQLLGMWGCSGKLICTTNVYWNSSWSN
KTYGDIWDNMTWMQWEREISNYTDIIYDLLEESQNQQEKNEQDLLALDRWNSLWNWFNITKWLWYIKIFIMIVGGLI
GLRIIFAVLSLVNRVRQGYSPLSLQTLIPSPRGPDRPGGIEEEGGEQDRNRSTRLVSGFLALAWDDLRSLCLFIYHR
LRDFILIAARAGELLGRSSLKGLQRGWEALKYLGGLVQYWGLELKKSAISLLDTLAIAVGEGTDRILEFVLGICRAI
RNIPTRIRQGFETALL*
>703010505.w100.T1
MRVMGIQRNYPQWWIWSMLGLWMLMICNGMWVTVYYGVPVWKEAKTTLFCASDAKAYEKEVHNVWATHACVPTDPNP
QEMVLKNVTENFNMWKNDMADQMHEDVISLWDQSLKPCVKLTPLCVTLNCTDANATASNTNATASNINATASKSSII
EEMKNCSFNITTELRDKREKKYALFYKLDIVQLGGNSSQYRLINCNTSVITQACPKVSFDPIPIHYCAPAGYAILKC
NNKTFNRTGPCNNVSTVQCTHGIKPVVSTQLLLNGSLAEGEIIIRSENITDNGKTIIVHLNESVKIECTRPSNNTRT
SIRIGPGQAFYATGQVIGDIREAHCNISESKWNETLQRVSKELKEYFPDKNITPQSSGGDPEITTHSFNCGGEFFY
CNTSSLFNRTYMANSTETNSTRTITLHCRIKQIINMWQEVGRAMYAPPIAGNITCISNITGLLLTRDGGNDTDTETF
RPGGGNMKDNWRSELYKYKVVEVKPLGVAPTNARRRVVEREKRAVGMGAVPLGFLGAAGSTMGAASITLTVQARQLL
SGIVQQQSNLLKAIEAQQHMLKLTVWGIKQLQARVLALERYLKNQQLLGMWGCSGKLICTTNVYWNSSWSNKTYGDI
WDNMTWMQWEREISNYTEIIYDLLEESQNQQEKNEQDLLALDRWNSLWNWFNITKWLWYIKIFIMIVGGLIGLETIF
AVLSLVNRVRQGYSPLSLQTLIPSPRGPDRPGGIEEEGGEQDRNRSTRLVSGFLALAWDDLRSLCLFIYHRLRDFIL
IAARAGELLGRSSLKRLRRGWKALKYLGGLVQYWGLELKRSAISLLDTLAIAVGEGTDRILEFVLGICRAIRNIPTR
IRQGFETALL*
>703010505.w136.B1
MRVRGIQRSYPQWWIWSMLGFWMLMICNGMWVTVYYGVPVWKEAKTTLFCASDAKAYEKEVHNVWATHACVPTDPNP
QEKVLKNVTDAKAYEKEVHNVWATHACVPTDPNPQEKVLKNVTENFNMWENDMVDQMHEDVISLWDQSLKPCVKLTP
LCVTLNCINATNATDSNSNILEGMKNCSFNIFTELDKFEKKNALFYKLDIVQLGGNSSQYRLINCNTSVITQACPK
VSFDPIPIHYCAPAGYAILKCNNKTFNGTGPCNNVSTVQCTHGIKPVVSTQLLLNGSLAEGEIIIRSKNITDNSKTI
IVHLNESVKIECTRPSNNTRTSIRIGPGQAFYATGQVIGNIREAHCNISESKWNETLQRVSEKLKKYFPDKNITFRP
SSGGDLEITTHSFNCGGEFFYCNTSSLFNRTYMATSTDMANSTETNSTRIITIECRIKQIINMWQEVGRAMYAPPIA
GNITCISNITGLLLTRDGGNNTEDTETFRPEGGNMKDNWRSELYKYKVVEVKPLGVAPTNARRRVVEREKRAVGMGA
VFLGFLGAAGSTMGAASITLTVQARQLLSGIVQQQSNLLKAIEAQQHMLKLTVWGIKQLQARVLALERYLKDQQLLG
MWNGCSGKLICTTNVYWNSSWSNKTYDDIWDNMTWMQWEREIGNYTNIIYELLEESQNQQEKNEQDLLALDRWNSLWN
WFNITNWLWYIKIFIMIVGGLIGLRIIFAVLSLVNRVRQGYSPLSLQTLIPSPRGPDRPGGIEEEGGEQDRNRSTRL
VSGFLALAWDDLRSLCLFIYHRLRDFILIAARAGELLGRSELKGLRRGWEALKYLGSLVQYWGLELKRSAISLLDTL
AIAVGEGTDRILEFVLGICRAIRNIPTRIRQGFETALL*
>703010505.w136.B19
MRVRGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCINATNATDSNSNILEGMKNCSFNITTE
LRDKREKKNALFYKLDIVQLGGSSSQYRLINCNTSVITQACPKVSFDPIPIHYCAPAGYAILKCNNKTFNGTGPCNN
VSTVQCTEGIKPVVSTQLLLNGSLAEGETIIRSKNITDNSKTIIVRLNESVKIECTRPSNNTETSIRIGPGQAHCNI
SESKWNETLQRVSEKLKKYFPDKNLTFRPSSGGDLEITTHSFNCGGEFFYCNTSSLFNRTYMATSTDMANSTETNST
RIITIHCRIKQIINMWQEVGRAMYAPPIAGNITCISNITGLLLTRDGGNNTEDTETFRPEGGNMKDNWRSELYKYKV
VEVKPLGVAPTNARRRVVEREKRAVGMGAVPLGFLGAAGSTMGAASITLTVQARQLLSGIVQQQSNLLKAIEAQQHM
LKLTVWGIKQLQARVLALERYLKDQQLLGMWGCSGKLICTTNVYWNSSWSNKTYDDIWDNMTWMQWEREISNYTNII
YELLEESQNQQEKNEQDLLALDRWNSLWNWFNITNWLWYIKIFIMIVGGLIGLRIIFAVLSLVNRVRQGYSPLSLQT
LIPSPRGPDRPGGIEEEGGEQDRNRSTRLVSGFLALAWDDLRSLCLFIYHRLRDFILIAARAGELLGRSSLKGLRRG
WEALKYLGSLVQYWGLELKRSAISLLDTLAIAVGEGTDRILEFVLGICRAIRNMPTRIRQGFETALL*
>703010505.w136.B10
MRVMGIQRSYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLSCINATNATDSNNSILEGMKNCSFNITTE
LRDKREKKNALFYKLDIVQLYGNSSQYRLINCNTSVITQACPKVSFDPIPIHYCAPAGYAILKCNNKTFNGTGPCNN
VSTVQCTEGIKPVVSTQLLLNGSLAEGEIIIRSKNITDNGKTIIVHLNESVKIECTRPSNNTRTSIRIGPGQAFYAT
GQVIGNIREAHCNISESKWNETLQRVSEKLKEYFPDKNITFQPSSGGDLEITTESPNCGGEFFYCNTSSLFNRTYMA
TSTDMANSTETNSTRITCRIKQIINMWQEVGRAMYAPPIAGNITCISNITGLLLTRDGGNNTEDTETFRPEGGN
MKDNWRSELYKYKVVEVKPLGVAPTNARRRVVEREKRAVGMGAVPLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYSDIWDNMTW
MQWEREISNYTDMIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSIGQYWGLELKRSAISLLDTLAIAVGEGTDRILEFVLGICRAIRNIPTRIRQGFE
TALL*
>703010505.w136.B27
MRVRGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCINATNATASNSNILEGMKNCSFNITTE
LRDKREKKNALFYKLDIVQLGGNSSQYRLINCNTSVITQACPKVSFDPIPIHYCAPAGYAILKCNNKTFNGTGPCNN
```

FIG. 17A cont'd

```
VSTVQCTHGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLKEYFPDKNITFQPSSGGDLEITTHSFNCGGEFFYCNTSSLFNRTYMA
NSTDMANSTETNSTRIITLHCRIKQIINMWQEVGRAMYAPPIAGNITCISNITGLLLTRDGGNNTEDTETFRPEGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYSDIWDNMTW
MQWEREISNYTDMIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w136.B12
#RVMGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCINATNATDSNSNILEGMKNCSFNITTE
LRDKREKKNALFYKLDIVQLGGNSSQYRLINCNTSVITQACPKVSFDPIPIHYCAPAGYAILKCNNKTFNGTGPCNN
VSTVQCTEGIKPVVSTQLLLNGSLAEGEIIIRSKNITDNSKTIIVHLNESVKIECTRPSNNTRTSIRIGPGQAFYAT
GQVIGNIREAHCNISESKWTETLQRVSEKLKKYFPDKNITFRPSSGGDLEITTHSFNCGGEFFYCNTSSLFNRTYMA
TSTDMANSTEINSTRIITIHCRIKQIINMWQEVGRAMYAPPIAGNITCISNITGLLLTRDGGNNTEDTETFRPEGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYDDIWDNMTW
MQWEREISNYTNIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w136.B16
MRVRGIQRSYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCINATNATDSNSNILEGMKNCSFNITTE
LRDKREKKNALFYKLD#IVQLGGNSSQYRLINCNTSVITQACPKVSFDPIPIHYCAPAGYAILKCNNKTFNGTGPCN
NVSTVQCTHGIKPVVSTQLLLNGSLAEGEIIIRSKNITDNSKTIIVHLNESVKIECTRPSNNTRTSIRIGPGQAFYA
TGQVIGNIREAHCNISESKWNETLQRVSEKLKKYFPDKNITFRPSSGGDLEITTHSFNCGGEFFYCNTSSLFNRTYM
ATSTDMANSTETNSTRIIITIHCRIKQIINMWQEVGRAMYAPPIAGNITCISNITGLLLTRDGGNNTEDTETFRPEGG
NMKDNWRSELYKYKVVEVKPLGVAPTNARRRVVEREKRAVGMGAVPLGFLGAAGSTMGAASITLTVQARQLLSGIVQ
QQSNLLKAIEAQQHMLKLTVWGIKQLQARVLALERYLKDQQLLGMWGCSGKLICTTNVYWNSSWSNKTYDDIWDNMT
WMQWEREISNYTNIIYELLEESQNQQEKNEQDLLALDRWNSLWNWFNITNWLWYIKIFIMIVGGLIGLRIIFAVLSL
VNRVRQGYSPLSLQTLIPSPRGPDRPGGIEEEGGEQDRNRSTRLVSGFLALAWDDLRSLCLFIYHRLRDFILIAARA
GELLGRSSLKGLRRGWEALKYLGSLVQYWGLELKRSAISLLDTLAIAVGEGTDRILEFVLGICRAIRNIPTRIRQGF
ETALL*
>703010505.w136.T2
MRVRGIQRSYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCINATNATDSNSNILEGMKNCSFNITTE
LRDKREKKNALFYKLDIVQLGGNSSQYRLINCNTSVITQACPKVSFDPIPIHYCAPAGYAILKCNNKTFNGTGPCNN
VSTVQCTEGIKPVVSTQLLLNGSLAEGEIIIRSKNITDNSKTIIVHLNESVKIECTRPSDNTRTSIRIGPGQAFYAT
GQVIGNIREAHCNISESKWNETLQRVSEKLKKYFPDKNITFRPSSGGDLEITTHSFNCGGEFFYCNTSSLFNRTYMA
TSTDMANSTETNSTRIITIHCRIKQIINMWQEVGRAMYAPPIAGNITCISNITGLLLTRDGGNNTEDTETFRPEGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYDDIWDNMTW
MQWEREISNYTNIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFSYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w136.B9
MRVRGIQRSYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCINATNATDSNSNILEGMKNCSFNITTE
LRDKREKKNALFYKLDIVQLGGNSSQYRLINCNTSVITQACPKVSFDPIPIHYCAPAGYAILKCNNKTFNGTGPCNN
VSTVQCTEGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLKKYFPDKNITFRPSSGGDLEITTHSFNCGGEFFYCNTSSLFNRTYMA
TSTDMANSTETNSTRIITIHCRIKQIINMWQEVGRAMYAPPIAGNITCISNITGLLLTRDGGNNTEDTETFRPEGGD
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYDDIWDNMTW
MQWEREISNYTNIIYELLEESQNQQEKNEQDLLALDRWNSLWNWFNITNWLWYIKIFIMIVGGLVGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w136.B4
MRVRGIQRSYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCINATNATDSNSNILEGMKNCSFNITTE
LRDKREKKNALFYKLDIVQLGGNSSQYRLINCNTSVITQACPKVSFDPIPIHYCAPAGYAILKCNNKTFNGTGPCNN
VSTVQCTEGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLKKYFPDKNITFRPSSGGDLEITTHSFNCGGEFFYCNTSSLFNRTYMA
TSTDMANSTETNSTRIITIHCRIKQIINMWQEVGRAMYAPPIAGNITCISNITGLLLTRDGGNNTEDTETFRPEGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYDDIWDNMTW
```

FIG. 17A cont'd

```
MQWEREISNYTNIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w136.B25
MRVRGIQRSYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCINATNATDSNSNILEGMKNCSFNITTE
LRDKREKKNALFYKLDIVQLGGNSSQYRLINCNTSVITQACPKVSFDPIPIHYCAPAGYAILKCNNKTFNGTGPCNN
VSTVQCTHGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLKKYFPDKNITFRPSSGGDLEITTHSFNCGGEFFYCNTSSLFNRTYMA
TSTDMANSTETNSTRIITIHCRIKQIINMWQEVGRAMYAPPIAGNITCISNITGLLLTRDGGNNTEDTETFRPEGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYDDIWDNMTW
MQWEREISNYTNIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w136.B11
MRVRGIQRSYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCINATNATDSNSNILEGMKNCSFNITTE
LRDKREKKNALFYKLDIVQLGGNSSQYRLINCNTSVITQACPKVSFDPIPIHYCAPAGYAILKCNNKTFNGTGPCNN
VSTVQCTHGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLKKYFPDKNITFRPSSGGDLEITTHSFNCGGEFFYCNTSSLFNRTYMA
TSTDMANSTETNSTRIITIHCRIKQIINMWQEVGRAMYAPPIAGNITCISNITGLLLTRDGGNNTEDTETFRPEGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYDDIWDNMTW
MQWEREISNYTNIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w136.B14
MRVRGIQRSYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCINATNATDSNSNILEGMKNCSFNITTE
LRDKREKKNALFYKLDIVQLGGNSSQYRLINCNTSVITQACPKVSFDPIPIHYCAPAGYAILKCNNKTFNGTGPCNN
VSTVQCTHGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLKKYFPDKNITFRPSSGGDLEITTHSFNCGGEFFYCNTSSLFNRTYMA
TSTDMANSTETNSTRIITIHCRIKQIINMWQEVGRAMYAPPIAGNITCISNITGLLLTRDGGNNTEDTETFRPEGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYDDIWDNMTW
MQWEREISNYTNIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLGQYWGLELKRSAISLLDTLAIAVGEGTDRILEFVLGICRAIRNIPTRIRQGFE
TALL*
>703010505.w136.B29
MRVRGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCINATNATDSNSNILEGMKNCSFNITTE
LRDKREKKNALFYKLDIVQLGGNSSQYRLINCNTSVITQACPKVSFDPIPIHYCAPAGYAILKCNNKTFNGTGPCNN
VSTVQCTHGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLKKYFPDKNITFRPSSGGDLEITTHSFNCGGEFFYCNTSSLFNRTYMA
TSTDMANSTETNSTRIITIHCRIKQIINMWQEVGRAMYAPPIAGNITCISNITGLLLTRDGGNNTEDTETFRPEGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYDDIWDNMTW
MQWEREISNYTNIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w136.B8
MRVRGIQRSYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCINATNATDSNSNILEGMKNCSFNITTE
LRDKREKKNALFYKLDIVQLGGNSSQYRLINCNTSVITQACPKVSFDPIPIHYCAPAGYAILKCNNKTFNGTGPCNN
VSTVQCTHGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLKKYFPDKNITFRPSSGGDLEITTHSFNCGGEFFYCNTSSLFNRTYMA
TSTDMANSTETNSTRIITIHCRIKQIINMWQEVGRAMYAPPIAGNITCISNITGLLLTRDGGNNTEDTETFRPEGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYDDIWDNMTW
MQWEREISNYTNIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w136.B37
```

FIG. 17A cont'd

```
MRVRGIQRSYPQWWIWSMLGFWMLMICNGMWVTVYYGVPVWKEAKTTLFCASDAKAYEKEVHNVWATHACVPTDPNP
QEMVLKNVTENFNMWENDMVDQMHEDVISLWDQSLKPCVKLTPLCVTLNCINATNATDSNSNILEGMKNCSFNITTE
LRDKREKKNALFYKLDIVQLGGNSSQYRLINCNTSVITQACPKVSFDPIPIHYCAPAGYAILKCNNKTFNGTGPCNN
VSTVQCTHGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLKKYFPDKNITFRPSSGGDLEITTHSFNCGGEFFYCNTSSLFNRTYMA
TSTDMANSTETNSTRIITIHCRIKQIINMWQEVGRAMYAPPIAGNITCISNITGLLLTRDGGNNTEDTETFRPEGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYDDIWDNMTW
MQWEREISNYTNIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w136.T1
MRVRGIQRSYPQWWIWSMLGFWMLMICNGMWVTVYYGVPVWKEAKTTLFCASDAKAYEKEVHNVWATHACVPTDPNP
QEMVLKNVTENFNMWENDMVDQMHEDVISLWDQSLKPCVKLTPLCVTLNCINATNATDSNSNILEGMKNCSFNITTE
LRDKREKKNALFYKLDIVQLGGNSSQYRLINCNTSVITQACPKVSFDPIPIHYCAPAGYAILKCNNKTFNGTGPCNN
VSTVQCTHGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLK#KYFPDKNITFRPSSGGDLEITTHSFNCGGEFFYCNTSSLFNRTYM
ATSTDMANSTETNSTRIITIHCRIKQIINMWQEVGRAMYAPPIAGNITCISNITGLLLTRDGGNNTEDTETFRPEGG
NMKDNWRSELYKYKVVEVKPLGVAPTNARRRVVEREKRAVGMGAVFLGFLGAAGSTMGAASITLTVQARQLLSGIVQ
QQSNLLKAIEAQQHMLKLTVWGIKQLQARVLALERYLKDQQLLGMWGCSGKLICTTNVYWNSSWSNKTYDDIWDNMT
WMQWEREISNYTNIIYELLEESQNQQEKNEQDLLALDRWNSLWNWFNITNWLWYIKIFIMIVGGLIGLRIIFAVLSL
VNRVRQGYSPLSLQTLIPSPRGPDRPGGIEEEGGEQDRNRSTRLVSGFLALAWDDLRSLCLFIYHRLRDFILIAARA
GELLGRSSLKGLREGWEALKYLGSLVQYWGLELKRSAISLLDTLAIAVGEGTDRILEFVLGICRAIRNIPTRIRQGF
ETALL*
>703010505.w136.B35
MRVRGIQRSYPQWWIWSMLGFWMLMICNGMWVTVYYGVPVWKEAKPTLFCASDAKAYEKEVHNVWATHACVPTDPNP
QEMVLKNVTENFNMWENDMVDQMHEDVISLWDQSLKPCVKLTPLCVTLNCINATNATDSNSNILEGMKNCSFNITTE
LRDKREKKNALFYKLDIVQLGGNSSQYRLINCNTSVIAQACPKVSFDPIPIHYCAPAGYAILKCNNKTFNGTGPCNN
VSTVQCTHGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLKKYFPDKNITFRPSSGGDLEITTHSFNCGGEFFYCNTSSLFNRTYMA
TSTDMANSTETNSTRIITIHCRIKQIINMWQEVGRAMYAPPIAGNITCISNITGLLLTRDGGNNTEDTETFRPEGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYDDIWDNMTW
MQWEREISNYTNIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w136.B36
MRVRGIQRSYPQWWIWSMLGFWMLMICNGMWVTVYYGVPVWKEAKTTLFCASDAKAYEKEVHNVWATHACVPTDPNP
QEMVLKNVTENFNMWENDMVDQMHEDVISLWDQSLKPCVKLTPLCVTLNCINATNATDSNSNILEGMKNCSFNITTE
LRDKREKKNALFYKLDIVQLGGNSSQYRLINCNTSVITQACPKVSFDPIPIHYCAPAGYAILKCNNKAFNGTGPCNN
VSTVQCTHGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLKKYFPDKNITFRPSSGGDLEITTHSFNCGGEFFYCNTSSLFNRTYMA
TSTDMANSTETNSTRIITIHCRIKQIINMWQEVGRAMYAPPIAGNITCISNITGLLLTRDGGNNTEDTETFRPEGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYDDIWDNMTW
MQWEREISNYTNIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w136.B22
MRVRGIQRSYPQWWIWSMLGFWMLMICNGMWVTVYYGVPVWKEAKTTLFCASDAKAYEKEVHNVWATHACVPTDPNP
QEMVLKNVTENFNMWENDMVDQMHEDVISLWDQSLKPCVKLTPLCVTLNCINATNATDSNSNILEGMKNCSFNITTE
LRDKREKKNALFYKLDIVQLGGNSSQYRLINCNTSVITQACPKVSFDPIPIHYCAPAGYAILKCNNKTFNGTGPCNN
VSTVQCTHGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLKKYFPDKNITFRPSSGGDLEITTHSFNCGGEFFYCNTSSLFNRTYMA
TSTDMANSTETNSTRIITIHCRIKQIINMWQEVGRAMYAPPIAGNITCISNITGLLLTRDGGNNTEDTETFRPEGGN
MKDWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYDDIWDNMTW
MQWEREISNYTNIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w136.B20
MRVRGIQRSYPQWWIWSMLGFWMLMICNGMWVTVYYGVPVWREAKTTLFCASDAKAYEKEVHNVWATHACVPTDPNP
QEMVLKNVTENFNMWENDMVDQMHEDVISLWDQSLKPCVKLTPLCVTLNCINATNATDSNSNILEGMKNCSFNITTE
LRDKREKKNALFYKLDIVQLGGNSSQYRLINCNTSVITQACPKVSFDPIPIHYCAPAGYAILKCNNKTFNGTGPCNN
VSTVQCTHGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLKKYFPDKNITFRPSSGGDLEITTHSFNCGGEFFYCNTSSLFNRTYMA
```

FIG. 17A cont'd

TSIDMANSTETNSTRIITIHCRIKQIINMWQEVGRAMYAPPIAGNITCISNITGLLLTRDGGNNTEDTETFRPEGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYDDIWDNMTW
MQWEREISNYTNIIYELLEESQNQQEKNEQDLLALDRWNSLWNWFNITNWLWYIKIFIMIVGGLIGLRIIFAVLSLV
NKVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w136.B29
MRVRGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCINATNATDSNSNILEGMKNCSFNITTE
LRDKFEKKNALFYKLDIVQLGGNSSQYRLINCNTSVITQACPKVSFDPIPIHYCAPAGYAILKCNNKTFNGTGPCNN
VSTVQCTHEGIKPVVSTQLLLNGSLAEGEIIIRSKNITDNSKTIIVHLNESVKIECTRPSNNTRTSIRIGPGQAFYAT
GQVIGNIEAHCNISESKWNETLQRVSEKLKEYFPDKNITFQPSSGGDLEITTHSFNCGGEFFYCNTSSLFNRTYMA
NSTDMANSTETNSTRIITIHCRIKQIINMWQEVGRAMYAPPIAGNITCISNITGLLLTRDGGNDTDTDTETFRPEGG
NMKDNWRSELYKYKVVEVKPLGVAPTNARRRVVEREKRAVGMGAVFLGFLGAAGSTMGAASITLTVQARQLLSGIVQ
QQSNLLKAIEAQQHMLKLTVWGIKQLQARVLALERYLKDQQLLGMWGCSGKLICTTNVYWNSSWSNKTYSDIWDNMT
WMQWEREISNYTEIIYDLLEESQNQQEKNEQDLLALDRWNSLWNWFNITNWLWYIKIFIMIVGGLIGLRIIFAVLSL
VNRVRQGYSPLSLQTLIPSPRGPDRPGGIEEEGGEQDRNRSTRLVSGFLALAWDDLRSLCLFIYHRLRDFILIAARA
GELLGRSSLKGLRRGWEALKYLGSLVQYWGLELKRSAISLLDTLAIAVGEGTDRILEFVLGICRAIRNIPTRIRQGF
ETALL*
>703010505.w136.B5
MRVHGTQRNYPQWWIWSMLGLWMLMICNGMWVTVYYGVPVWKEAKTTLFCASDAKAYEKEVHNVWATHACVPTDPNP
QEMVLKNVTENFNMWKNDMADQMHEDVISLWDQSLKPCVKLTPLCVTLYCINATANATVSNGSSIIEEMKNCSFNITT
ELRDKREKKNALFYKLDIVQLDGNSSQYRLINCNTSAITQACPKVSFDPIPIHYCAPAGYAILKCNNKTFNGTGPCN
NVSTVQCTHGIKPVVSTQLLLNGSLAEGEIIIRSENITNSAKTIIVHLNESVKIECTRPSNNTRTSIRIGPGQAPYA
TGQVIGDIRQAHCNISESKWNETLQRVSEKLKEYFPNKTITTQPGSGGDPEITTHSFNCGGEFFYCNTSSLFNRTYM
ANSTDMANSTETNSTRIITLHCRIKQIINMWQEVGRAMYAPPIAGNITCISNITGLLLTRDGGNSSKETETFRPGGG
NMKDNWRSELYKYKVVEVKPLGVAPTNARREVVEREKRAVGMGAVFLGFLGAAGSTMGAASITLTVQARQLLSGIVQ
QQSNLLKAIEAQQHMLKLTVWGIKQLQARVLALERYLKDQQLLGMWGCSGKLICTTNVYWNSSWSNKTYGDIWDNMT
WMQWEREISNYTDLIYDLLEESQNQQEKNEQDLLALDRWNSLWNWFNITKWLWYIKIFIMIVGGLIGLRIIFAVLSL
VNRVRQGYSPLSLQTLIPSPRGPDRPGGIEEEGGEQDRNRSTRLVSGFLALAWDDLRSLCLFLYHRLRDFILIAARA
GELLGRSSLKGLRRGWEALKYLGGLVQYWGLELKRSAISLLDTLAIAVGEGTDRILEFVLGICRAIRNIPTRIRQGF
ETALL*
>703010505.w136.B26
MRVHGIQRNCPQWWIWSMLGLWMLMICNGMWVTVYYGVPVWKEAKTTLFCASDAKAYEKEVHNVWATHACVPTDPNP
QEMVLKNVTENFNMWKNDMVNQMHEDVISLWDQSLKPCVKLTPLCVTLYCTNATANATVSNSSIIEEMKNCSFNITT
ELRDKREKKNALFYKLDIVQLDGNSSCYRLINCNTSAITQACPKVSFDPIPIHYCAPAGYAILKCNNKTFNGTGPCN
NVSTVQCTHGIKPVVSTQLLLNGSLAEGEIIIRSENITNSAKTIIVHLNESVKIECTRPSNNTRTSIRIGPGQAFYA
TGQVIGDIRKAHCNISESKWNETLQRVSEKLKEYFPDKNITFQPSSGGDPEITTHSFNCGGEFFYCNTSSLFNRTYM
ANSTETNSTRTITLHCRIKQIINMWQEVGRAMYAPPIAGNITCIGNITGLLLTDGGENDTETFPVGGNMKDNWRS
ELYKYKVVEVKPLGVAPTKARRRVVEREKRAVGMGAVFLGFLGAAGSTMGAASITLTVQARQLLSGIVQQQSNLLKA
IEAQQHMLKLTVWGIKQLQAFVLALERYLKDQQLLGMWGCSGKLICTTNVYWNSSWSNKTYGDIWDNMTWMQWEREI
SNYTTNIIYDLLEESQNQQEKNEQDLLALDRWNSLWNWFNITKWLWYIKIFIMIVGGLIGLRIIFAVLSLVNRVRQGY
SPLSLQTLIPSPRGPDRPGGIEEEGGEQDRNRSTRLVSGFLALAWDDLRSLCLFIYHRLRDFILIAARAGELLGRSS
LKGLRRGWEALKYLGGIVQYWGLELKRSAISLLDTLAIAVGEGTDRILEFVLGICRAIRNIPTRIRQGFETALL*
>703010505.w136.B30
MRVRGIQRNYPQWWIWSMLGLWMLMICNGMWVTVYYGVPVWKEAKTTLFCASDAKAHEKEVHNVWATHACVPTDPNP
QEMVLKNVTENFNMWKNDMVDQMHEDVISLWDQSLKPCVKLTPLCVTLYCTNATANATVSNSSIIEEMKNCSFNITT
ELRDKREKKYALFYKLDIVQLDGNSSGNSSQYRLINCNTSAITQACPKVSFDPIPIHYCAPAGYAILKCNNKTFNGT
GPCNNVSTVQCTHEGIKPVVSTQLLLNGSLAEGETIIRSKNITDNGQTIIVHLNESVKIECTRPSNNTRTSIRIGPGQ
AFYATGQVIGDIRKAHCNISESKWNETLQRVSEKLKEYFPNKNITFQPSSGGDPEITTHSFNCGGEFFYCNTSSLFN
RTYMANSTETNSTRTITLHCRIKQIINMWQEVGRAMYAPPIAGNITCISNITGLLLTRDGGNSSKETETFRPGGGNM
KDNWRSELYKYKVVEVKPLGVAPTNARRVVEREKRAVGMGAVFLGFLGAAGSTMGAASITLTVQARQLLSGIVQQQ
SNLLKAIEAQQHMLRLTVWGIKQLQARVLALERYLKDQQLLGMWGCSGKLICTTNVYWNSSWSNKTYGDIWNNMTWM
QWEREISNYTDMIYNLLEESQNQQEKNEQDLLALDRWNSLWNWFNITKWLWYIKIFIMIVGGLIGLRIIFAVLSLVN
RVRQGYSPLSLQTLIPSPRGPDRPGGIEEEGGEQDRKRSTRLVSGFLALVWDDLRSLCLFLYHRLRDFILIAARAGE
LLGRSSLKGLRRGWEALKYLGSLVQYWGLELKGSAISLLDTLAIAVGEGTDRILEFVLGICRAIRNIPTRIRQGFET
ALL*
>703010505.w136.B7
MRVRGIQRNYPQWWIWSMLGLWMLMICNGMWVTVYYGVPVWKEAKTTLFCASDAKAYEKEMHNVWATHACVPTDPNP
QEMVLKNVTENFNMWKNDMVDQMHEDVISLWDQSLKPCVKLTPLCVTLNCTDANDANATASNTNATVSNNSSIIEEM
KNCSFNITTELRDKIEKKYALFYKLDIVQLDGNSSEYRFINCNTSAITQACPKVSFDPIPIHYCAPAGYAILKCNNK
TFNGTGPCNNVSTVQCTHGIKPVVSTQLLLNGSLAEGEIIIRSKNITDNGNTIIVHLNESVKIECTRPSNNTRTSIR
IGPGQAFYATGQVIGDIRKAHCNISESKWNETLQRVSEKLKEYFPNKTITPQPSSGGDPEITTHSFNCGGEFFYCNT
SSLFNRTYMANSTETNSTRIITLHCRIKQIINMWQEVGRAMYAPPIAGNITCISNITGLLLTRDGGNTTDMETFRPG
GGNMKDNWRSELYKYKVVEVKPLGVAPTNARRVVEREKRAVGMGAVPLGFLGAAGSTMGAASITLTVQARQLLSGI
VQQQSNLLKAIEAQQHMLKLTVWGIKQLQARVLALERYLKDQQLLGMWGCSGKLICTTNVYWNSSWSNKTYDDIWDN
MTI*MQWEREISNYTEIIYDLLEESQNQQEKNEQDLLALDRWNSLWNWFNITKWLWYIKIFIMIVGGLIGLRIIFAVL
SLVNRVRQGYSPLSLQTLIPSPRGPDRPGGIEEEGGEQDRNRSTRLVSGFLALAWDDLRSLCLFIYHRLRDFILIAA

FIG. 17A cont'd

```
RAGELLGRSSLKGLRRGWEALKYLGGLVQYWGLELKKSAISLLDTLAIAVGEGTDRTLEFVLGICRAIRNIPTRIRQ
GFETALL*
>703010505.w136.B2
MRVRGIQRNYPQWWIWSMLGLWMLMICNGMWVTVYYGVPVWKEAKTTLFCASDAKAYEKEAHNVWATHACVPTDPNP
QEMVLKNVTENFNMWENDMVDQMHEDVISLWDQSLKPCVKLTPLCVTLNCTDANATASNTNATVSNIKATVSNSSII
EEMKNCSFNITTELRDKIEKKYALFYKLDIVQLDGNSTQYRFINCNTSAITQACPKVSFDPIPIHYCAPAGYAILKC
NNKTFNGTGPCNNVSTVQCTHGIKPVVSTQLLLNGSLAEGEIIIRSENITDNGKTIIVHLNESVKIECTRPGNNTRT
SIRIGPGQAFYATGQVIGDIRQAHCNISESKWNETLQRVSEKLKEYFPNKTITFQPSSGGDPEITTHSFNCGGEFFY
CNTSSLFNRTYMANSTETNSTRTITLHCRIKQIINMWQEVGRAMYAPPIAGNITCISNITGLLLTRDGGNTTDIETF
RPGGGNMKDNWRSELYKYKVVEVKPLGVAPTKARREVVBREKRAVGMGAVFLGFLGAAGSTMGAASITLTVQARQLL
SGIVQQQSNLLKAIEAQQHMLKLTVWGIKQLQARVLALERYLKDQQLLGMWGCSGKLICTTNVYWNSSWSNKTYDDI
WDNMTWMQWEREISNYTEIIYDLLEESQNQQEKNEQDLLALDRWNSLWNWFNITKWLWYIKIFIMIVGGLIGLRIIF
AVLSLVNEVRQGYSPLSLQTLIPSPRGPDRPGGIEEEGGEQDRNRSTRLVSGFLALAWDDLRSLCLFIYHRLRDFIL
IAARAGELLGRSSLKGLRRGWEALKYLGGIVQYWGLELKRSAISLLDTLAIAVGEGTDRILEFVLGICRAIRNIPTR
IRQGFETALL*
>703010505.w136.B3
MRVRGIQRNYPQWWIWSMLGLWMLMICNGMWVTVYYGVPVWKEAKTTLFCASDAKAYEKEAHNVWATHACVPTDPNP
QEMVLKNVTENFNMWBNDMVDQMHEDVISLWDQSLEPCVKLTPLCVTLNCTDANATASNANATASNTNATVSNDSSI
IEEMKNCSFNITTELRDKIERKYALFYKLDIVQLDGNSTQYRFINCNTSAITQACPKVSFDPIPIHYCAPAGYAILK
CNNKTFNGTGPCNNVSTVQCTBGIKPVVSTQLLLNGSLAEGEIIIRSKNITDNGNTIIVHLNESVKIECTRPSNNTR
TSIRIGPGQAFYATGQVIGDIRQAHCNISESKWNETLQRVSKKLKEYFPDKNITFQPSSGGDPEITTHSFNCGGEFF
YCNTSSLFNRTYMANSTETNSTRTITLHCRIKQITNMWQEVGRAMYAPPIAGNITCISNITGLLLTRDGGNSSKETE
TFRPGGGNMKDNWRSELYKYKVVEVKPLGVAPTNARRRVVEREKRAVGMGAVPLGFLGAAGSTMGAASITLTVQARQ
LLSGIVQQQSNLLKAIEAQQHMLRLTVWGIKQLQARVLALERYLKDQQLLGMWGCSGKLICTTNVYWNSSWSNKTYS
DIWDNMTWMQWEGEISNYTRIIYNLLEESQNQQBKNEQDLLALDRWNSLWNWFNITKWLNYIKIFIMIVGGLIGLRI
IFAVLSLVNRVRQGYSPLSLQTLIPSPRGPDRPGGIEEEGGEQDRKRSTRLVSGFLALVWDDLRSLCLFLYHRLRDF
ILIAARAGELLGRSSLKGLRRGWEALKYLGSLVQYWGLELKGSAISLLDTLAIAVGEGTDRILEFVLGICRAIRNIP
TRIRQGFETALL*
>703010505.w136.B24
MRVMGRQRNYPQWWIWSMLGLWMLMICNGMWVTVYYGVPVWKEAKTTLFCASDAKAYEKEVHNVWATHACVPTDPNP
QEMVLKNVTENFNMWKNDMVDQMHEDVISLWDQSLTPCVKLTCTDANATASNATASNTNATASNSSIMIE
EMKNCSFNIFTELRDKREKKYALFYKLDIVQLDGNSSQYRLINCNTSVITQACPKVSFDPIPIHYCAPAGYAILKCN
NKTFNGTGPCNNVSTVQCTHGIKPVVSTQLLLNGSLAEGEIIIRSENITDNAKTIIVHLNESVKIECTRPSNNTRTS
IRIGPGQAFYATGQVIGDIRKAHCNISESKWSETLQRVSKKLKEYFPDKNITFQPSSGGDPEITTHSFNCGGEFFYC
NTSSLFNRTDMANSTETNSTRITTLHCRIKQIINMWQEVGRAMYAPPIAGNITCISNITGLLLTRDGGNSSKETETF
RPGGGNMEDNWRSELYKYKVVEVKPLGVAPTNARERVVEREKKAVGMGAVPLGFLGAAGSTMGAASITLTVQARQLL
SGIVQQQSNLLKAIEAQQHMLKLTVWGIKQLQARVLALERYLKDQQLLGMWGCSGKLICTTNVYWNSSWSNKTYSDI
WDNMTWMQWEKEISNYTEMIYDLLEESQNQQEKNEQDLLALDRWNSLWNWFNITKWLWYIKIFIMIVGGLIGLRIIF
AVLSLVNEVRQGYSPLSLQTLIPSPRGPDRPGGIEEEGGEQDRKRSTRLVSGFLALVWDDLRSLCLFLYHRLRDFIL
IAARAGELLGRSSLKGLRRGWEALKYLGSLVQYWSLELKRSAISLLDTLAIAVGEGTDRILEFVLGICRAIRNIPTR
IRQGFETALL*
>703010505.w136.B23
MRVMGRQRNYPQWWIWSMLGLWMLMICNGMWVTVYYGVPVWKEAKTTLFCASDAKAYEKEVHNVWATHACVPTDPNP
QEMVLKNVTENFNMWKNDMVDQMHEDVISLWDQSLTPCVKLTPLCVTLNCTDANDTASNSSIIKGMNNSIVGEMKNC
SFNITTELRDKREKKNALFYKLDIVQLDGNSSEYRLINCNTSVITQACPKVSFDPIPIHYCAPAGYAILKCNNKTFN
GTGPCNNVSTVQCTHGIKPVVSTQLLLNGSLAEGEIIIRSENITDNAKTIIVHLNESVKIECTRPSNNTRTSIRIGP
GQAFYATGQVIGDIRKAHCNISESKWNETLQRVSKKLKEYFPDKNITFQPSSGGDPEITTHSFNCGGEFFYCNTSSL
FNRTYMANSTDMANSAETNSTRTITLHCRIKQIINMWQEVGRAMYAPPIAGNITCISNITGLLLTRDGGNSTETET
FRPGGGNMKDNWRSELYKYKVVEVKPLGVAPTNARKRVVEREKRAVGMGAVPLGFLGAAGSTMGAASITLTVQARQL
LSGIVQQQSNLLKAIEAQQHMLRLTVWGIKQLQARVLALERYLKDQQLLGMWGCSGKLICTTNVYWNSSWSNKTYDD
IWDNMTWMQWEGEISNYTNIIYDLLEESQNQQEKNEQDLLALDRWNSLWNWFNITNWLWYIKIFIMIVGGLIGLRII
FAVLSLVNRVRQGYSPLSLQTLIPSPRGPDRPGGIEEEGGEQDRKRSTRLVSGFLALVWDDLRSLCLFLYHRLRDFI
LIAARAGELLGRSSLKGLRRGWEALKYLGSLVQYWGLELKRSAISLLDTLAIAVGEGTDRILEFVLGICRAIRNIPT
RIRQGFETALL*
>703010505.w136.B18
MRVMGRQRNYPQWWIWSMLGLWMLMICNGMWVTVYYGVPVWKEAKTTLFCASDAKAYEKEVHNVWATHACVPTDPNP
QEMVLKNVTENFNMWKNDMVDQMHEDVISLWDQSLTPCVKLTPLCVTLNCTDANDTASNSSIIKGMNNSIVGEMKNC
SFNITTELRDKREKKNALFYKLDIVQLDGNSSEYRLINCNTSVITQACPKVSFDPIPIHYCAPAGYAILKCNNKTFN
GTGPCNNVSTVQCTHGIKPVVSTQLLLNGSLAEGEIIIRSENITDNAKTIIVHLNESVKIECTRPSNNTRTSIRIGP
GQAFYATGQVIGDIRKAHCNISESKWNETLQRVSKELKEYFPDKNITFQPSSGGDPEITTHSFNCGGEFFYCNTSSL
FNRTYMANSTDMANSAETNSTRTITLHCRIKQIINMWQEVGRAMYAPPIAGNITCISNITGLLLTRDGGNSSTETET
FRPGGGNMKDNWRSELYKYKVVEVKPLGVAPTNARRRVVEREKRAVGMGAVPLGFLGAAGSTMGAASITLTVQARQL
LSGIVQQQSNLLKAIEAQQHMLRLTVWGIKQLQARVLALERYLKDQQLLGMWGCSGKLICTTNVYWNSSWSNKTYDD
IWDNMTWMQWEGEISNYTNIIYDLLEESQNQQEKNEQDLLALDRWNSLWNWFNITNWLWYIKIFIMIVGGLIGLRII
FAVLSLVNRVRQGYSPLSLQTLIPSPRGPDRPGGIEEEGGEQDRKRSTRLVSGFLALVWDDLRSLCLFLYHRLRDFI
LIAARAGELLGRSSLKGLRRGWEALKYLGSLVQYWGLELKRSAISLLDTLAIAVGEGTDRILEFVLGICRAIRNIPT
RIRQGFETALL*
>703010505.w136.B33
MRVMGRQRNYPQWWIWSMLGLWMLMICNGMWVTVYYGVPVWKEAKTTLFCASDAKAYEKEVHNVWATHACVPTDPNP
QEMVLKNVTENFNMWKNDMVDQMHEDVISLWDQSLTPCVKLTPLCVTLNCTDANDTASNSSIIKGMNNSIVGEMKNC
```

FIG. 17A cont'd

```
SFNITTELRDKREKKNALFYKLDIVQLDGNSSEYRLINCNTSVITQACPKVSFDPIPIHYCAPAGYAILKCNNKTFN
GTGPCNNVSTVQCTHGIKPVVSTQLLLNGSLAEGEIIIRSENITDNAKTIIVHLNESVKIECTRPSNNTRTSIRIGP
GQAFYATGQVIGDIRKAHCNISESKWNETLQRVSKKLKEYFPDXNITFQPSSGGDPEITTHSFNCGGEFFYCNTSSL
FNRTYMANSTDMANSAETNSTRTITLHCRIKQIINMWQEVGRAMYAPPIAGNITCISNITGLLLTRDGGNSSTETET
FRPGGGNMKDNWRSELYKYKVVEVKPLGVAPTNARERVVEREKRAVGMGAVFLGFLGAAGSTMGAASITLTVQARQL
LSGIVQQQSNLLKAIEAQQHMLRLTVWGIKQLQARVLALERYLKDQQLLGMWGCSGKLICTTNVYWNSSWSNKTYGD
IWDNMTWMQWESEISNYTNIIYDLLEESQNQQEKNEQDLLALDRWNSLWNWFNITKWLWYIKIFIMIVGGLIGLRII
FAVLSLVNRVRQGYSPLSLQTLIPSPRGPDRPGGIEEEGGEQDRKESTRLVSGFLALVWDDLRSLCLFLYHRLRDFI
LIAARAGELLGRSSLKGLRRGWEALKYLGSLVQYWGLELKGSAISLLDTLAIAVGEGTDRILEFVLGICRAIRNIPT
RIRQGFETALL*
>703010505.w136.B38
MRVMGRQRNYPQWWIWSMLGLWMLMICNGMWVTVYYGVPVWKEAKTTLFCASDAKAYEKEVHNVWATHACVPTDPNP
QEMVLKNVTENFNMWKNDMVDQMHEDVISLWDQSLTPCVKLTPLCVTLNCTDANDTASNSSIIXGMNNSIVGEMKNC
SFNITTELRDKREKKNALFYKLDIVQLDGNSSEYRLINCNTSVITQACPKVSFDPIPIHYCAPAGYAILKCNNKTFN
GTGPCNNVSTVQCTHGIKPVVSTQLLLNGSLAEGEIIIRSENITDNAKTIIVHLNESVKIECTRPSNNTPTSIRIGP
GQAFYATGQVIGDIRKAHCNISESKWNETLQRVSKKLKEYFPDXNITFQPSSGGDPEITTHSFNCGGEFFYCNTSSL
FNRTYMANSTDMANSAETNSTRTITLHCRIKQIINMWQEVGRAMYAPPIAGNITCISNITGLLLTRDGGNSSTETET
FRPGGGNMKDNWRSELYKYKVVEVKPLGIAPTNARERVVEREKRAVGMGAVFLGFLGAAGSTMGAASITLTVQARQL
LSGIVQQQSNLLKAIEAQQHMLRLTVWGIKQLQARVLALERYLKDQQLLGMWGCSGKLICTTNVYWNSSWSNKTYGD
IWDNMTWMQWESEISNYTNIIYDLLEESQNQQEKNEQDLLALDRWNSLWNWFNITKWLWYIKIFIMIVGGLIGLRII
FAVLSLVNRVRQGYSPLSLQTLIPSPRGPDRPGGIEEEGGEQDRKESTRLVSGFLALVWDDLRSLCLFLYHRLRDFI
LIAARAGELLGRSSLKGLRRGWEALKYLGSLVQYWGLELKGSAISLLDTLAIAVGEGTDRILEFVLGICPAIRNIPT
RIRQGFETALL*
>703010505.w160.A1
MRVREGIQRNYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVLTPLCVTLNCINATNATDSKSNILEGMKNCSFNITTE
LRDKREKKNALFYKLDIVQLGGNSNSSQYRLINCNTSVITQACPKVSFDPIPIHYCAPAGYAILKCNNKTFNGTGPC
NNVSTVQCTHGIKPVVSTQLLLNGSLAEGEIIIRSKNITDNSKTIIVHLNESVKIECTRPSNNTRTSIRIGPGQAFY
ATGQVIGNIREAHCNISESKWNETLQRVSEKLKEYFPQKNITFQPSSGGDLEITTHSFNCGGEFFYCNTSSLFNRTY
MATGTDMANSTETNIITIHCRIKQIINMWQEVGRAMYAPPIAGNITCISNITGLLLTRDGGNSTEDTETFRPVGGNM
KDNWSSELYKYKVVEVKPLGVAPTNARERVVEREKRAVGMGAVFLGFLGAAGSITLTVQARQLLSGIVQQQ
SNLLKAIEAQQHMLKLTVWGIKQLQARVLALERYLKDQQLLGMWGCSGKLICTTNVYWNSSWSNKTYDDIWDNMTWM
QWEREEISNYTNIIYELLEESQNQQEKNEQDLLALDRWNSLWNWFNITNWLWYIKIFIMIVGGLIGLRIIFAVLSLVN
RVRQGYSPLSLQTLIPSPRGPDRPGGIEEEGGEQDRNRSTRLVSGFLALAWDDLRSLCLFIYHRLEDFILIAARAGE
LLGRSSLKGLREGWEALKYLGSLVQYWGLELKRSAISLLDTLAIAVGEGTDRILEFVLGICRAIRNIPTRIRQGFET
ALL*
>703010505.w160.A2
MRVREGIQRNYPQWWIWSMLGFWMLMICNGMWVTVYYGVPVWKEAKTTLFCASDAKAYEKEVHNVWATHACVPTDPNP
QEMVLKNVTENFNMWENDMVDQMHEDVISLWDQSLEPCVRLTPLCVTLNCINATNATASDSSILDGMKNCSFNITTE
LRDKREKKNALFFYKLDIVQLGNSSQYRLINCNTSVITQACPKVSFDPIPIHYCAPAGYAILKCNNKTFNGTGPCN
NVSTVQCTHGIKPVVSTQLLLNGSLAEGEIIISSKNITDNSKTIIVHLNESVKIECTRPSNNTRISIRIGPGQAFYA
TGQVIGNIREAHCNISESKWNETLQRVSEKLKEYFPDKNITFQPSSGGDLEITTHSFNCGGEFFYCNTSSLFNRTYM
ATSTDMANSTETNSTQIIITIHCRIKQIINMWQEVGRAMYAPPIAGNITCISNVTGLLLTRDGGNNTEDTETFRPVGG
NMKDNWSSELYKYKVVEVKPLGVAPTNARERVVEREKRAVGMGAVFLGFLGAAGSTMGAASITLTVQARQLLSGIVQ
QQSNLLKAIEAQQHMLKLTVWGIKQLQARVLALERYLKDQQLLGMWGCSGKLICTTNVYWNSSWSNKTYDDIWDNMT
WMQWEREEISNYTELIYELLEESQNQQEKNFQDLLALDRWNSLWNWFNITNWLWYIKIFIMIVGGLIGLRIIFAVLSL
VNRVRQGYSPLSLQTLIPSPRGPDRPGGIEEEGGEQDRNRSTRLVSGFLALAWDDLRSLCLFIYHRLRDFILIAARA
GELLGRSSLKGLRRGWEALKYLGSLVQYWGLELKRSAISLLDTLAIAVGEGTDRILEFVLGICRAIRNIPTRIRQGF
ETALL*
>703010505.w160.A4
MRVREGIQRSYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLEPCVKLTPLCVTLNCINATNATDSNSNILEGMKNCSFNITTE
LRDKREKKNALFYKLDIVQLGGNSSQYRLINCNTSVITQACPKVSFDPIPIHYCAPAGYAILKCNNKTFNGTGPCNN
VSTVQCTHGIKPVVSTQLLLNGSLAEGEIIRSKNITDNSKTIIVHLNESVKIECTRPSNNTRTSIRIGPGQAFYAT
GQVIGNIREAHCNISESKWNETLQRVSEKLK#KYFPDKNITFRPSSGGDLEITTHSFNCGGEFFYCNTSSLFNRTYM
ATSTDMANSTETNIITIHCRIKQIINMWQEVGRAMYAPPIAGNITCISNITGLLLTRDGGNNTEDTETFRPVGGNMK
DNWSSELYKYKVVEVKPLGVAPTNARERVVEREKRAVGMGAVFLGFLGAAGSTMGAASITLTVQARQLLSGIVQQS
NLLKAIEAQQHMLKLTVWGIKQLQARVLALERYLKDQQLLGMWGCSGKLICTTNVYWNSSWSNKTYSDIWDNMTWMQ
WEREEISNYTDMIYELLEESQNQQEKNEQDLLALDRWNSLWNWFNITNWLWYIKIFIMIVGGLIGLRIIFAVLSLVNR
VRQGYSPLSLQTLIPSPRGPDRPGGIEEEGGEQDRNRSTRLVSGFLALAWDDLRSLCLFIYHRLRDFILIAARAGEL
LGRSSLKGLRRGWEALKYLGSLVQYWGLELKRSAISLLDTLAIAVGEGTDRILEFVLGICRAIRNIPTRIRQGFETA
LL*
>703010505.w160.A5
MRVREGIQRNYPQWWIWSMLGFWMLMICNGMWVTVYYGVPVWKEAKTTLFCASDAKAYEKEVHNVWATHACVPTDPNP
QEMVLKNVTENFNMWENDMVDQMHEDVISLWDQSLKPCVKLTPLCVTLNCINATNATDSNSSILGGMKNCSFNITTE
LRDKREKKNALFYKLDIVQLGSNSSQYRLINCNTSVITQACPKVSFDPIPIHYCAPAGYAILKCNNKTFNGTGPCNN
VSTVQCTEGIKPVVSTQLLLNGSLAEGEIIRSKNITDNSKTIIVHLNESVKIECTRPSNNTRTSIRIGPGQAFYAT
GQVIGNIREAHCNISESKWNETLQRVSEKLKEYFPDKNITFQPSSGGDLEITTHSFNCGGEFFYCNTSSLFSRTYMA
NSTDMANSTETNSTQIITIHCRIKQIINMWQEVGRAMYAPPIAGNITCISNITGLLLTRDGGNNTEDTETFRPEGGN
MKDNWRSELYKYKVVEVKPLGVAPTNARRRVVEREKRAVGMGAVFLGFLGAAGSTMGAASITLTVQARQLLSGIVQQ
```

FIG. 17A cont'd

```
QSNLLKAIEAQQHMLKLTVWGIKQLQARVLALERYLKDQQLLGMWGCSGKLICTTNVYWNSSWSNKTYDDIWDNMTW
MQWEREISNYTDLIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYERLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w160.B2
MRVRGIQRSYPQWWIWSMLGFWMLMICNGMWVTVYYGVPVWKEAKTTLFCASDAKAYEKEVHNVWATHACVPTDPNP
QEMVLKNVTENFNMWENDMVDQMHEDVISLWDQSLKPCVKLTPLCVTLNCINATNATASDSSILDGMKNCSFNITTE
LRDKREKKNALFYKLDIVQLGGNSSQYRLINCNTSVITQACPKVSFDPIPIHYCAPAGYAILKCNNKTFNGTGPCNN
VSTVQCTEGIKPVVSTQLLLNGSLAEGEIIIRSKNITDNSKTIIVHFNESVKIECTRPSNNTRTSIRIGPGQAFYAT
GQVIGNIREAHCNISESKWNETLQRVSEKLKEYFPDKNITFQPSSGGDLEITTHSPNCGGEFFYCNTSSLFNRTYMA
NSTDMANSTETNSTQIITIHCRIKQIINMWQEVGRAMYAPPIAGNITCISNITGLLLTRDGGNNTEDTETFRPVGGN
MKDNWSSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYDDIWDNMTW
MQWEREISNYTNIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYERLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w160.C1
MRVTGIQRNYPQWWIWSMLGLWMLMICNGMWVTVYYGVPVWKEAKTTLFCASDAKGYEKEVHNVWATHACVPTDPNP
QEMVLKNVTENFNMWKNDMVDQMHEDVISLWDQSLKPCVKLTPLCVTLYCTNATANATASNINVTVSNSSIIEEMKN
CSFNITTELRDKREKKYALFYKLDIIQLDGSSSQYRLINCNTSAITQACPKVSFDPIPIHYCAPAGYAILKCNNKTF
NGTGPCNNVSTVQCTHGIKPVVSTQLLLNGSLAEGEIIIRSENITNSAKTIIVHLNESVKIECTRPSNNTRTSIGIG
PGGQAFYATGQVIGDIRKAHCNISESKWNETLQRVSKKLKEYFPDKNITFQPSSGGDPEVTTHSFNCGGEFFYCNTSS
LFNRTYMTNSTDMANSTETNRTITIHCRIKQIINMWQEVGRAMYAPPIAGNITCISNITGLLLTRDGGNSSTGTETF
RPGGGNMKDNWRSELYKYKVVEVKPLGVAPTNARRRVVEREKRAVGMGAVFLGFLGAAGSTMGAASITLTVQARQLL
SGIVQQQSNLLKAIEAQQHMLKLTVWGIKQLQARVLALERYLKDQQLLGMWGCSGKLICTTNVYWNSSWSNKTYVDI
WDNMTWMQWEREISNYTDIIYDLLEESQNQQEKNEQDLLALDRWNSLWNWFNITKWLWYIKIFIMIVGGLIGLRIIF
AVLSLVNRVRQGYSPLSLQTLIPSPRGPDRPGGIEEEGGEQDRNRSTRLVSGFLALAWDDLRSLCLFLYHRLRDFIL
IAARAGELLGRSSLKGLRRGWEALKYLGGLVQYWGLELKRSAISLLDTLAIAVGEGTDRILEFVLGICRAIRNIPTR
IRQGFETALL*
>703010505.w160.C10
MRVRGIQRSYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCINATNATASDSSILDGMKNCSFNITTE
LRDKREKKNALFYKLDIVQLGGNSSQYRLINCNTSVITQACPKVSFDPIPIHYCAPAGYAILKCNNKTFNGTGPCNN
VSTVQCTEGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLKEYFPDKNITFQPSSGGDLEITTHSFNCGGEFFYCNTSSLFNRTYMA
NSTDMANSTETNSTQIITIHCRIKQIINMWQEVGRAMYAPPIAGNITCISNITGLLLTRDGGNNTETSETVSEIFRP
VGGNMKDNWSSELYKYKVVEVKPLGVAPTNARRRVVEREKRAVGMGAVFLGFLGAAGSTMGAASITLTVQARQLLSG
IVQQQSNLLKAIEAQHQMLKLTVWGIKQLQARVLALERYLKDQQLLGMWGCSGKLICTTNVYWNSSWSNKTYDDIWD
NMTWMQWEREISNYTEIIYELLEESQNQQEKNEQDLLALDRWNSLWNWFNITNWLWYIKIFIMIVGGLIGLRIIFAV
LSLVNRVRQGYSPLSLQTLIPSPRGPDRPGGIEEEGGEQDRNRSTRLVSGFLALAWDDLRSLCLFIYHRLRDFILIA
ARAGELLGRSSLKGLRRGWEALKYLGSLVQYWGLELKRSAISLLDTLAIAVGEGTDRILEFVLGICRAIRNIPTRIR
QGFETALL*
>703010505.w160.C11
MRVRGIQRNYPQWWIWSMLGFWMLMICNGMWVTVYYGVPVWKEAKTTLFCASDAKAYEKEVHNVWATHACVPTDPNP
QEMVLKNVTENFNMWENDMVDQMHEDVISLWDQSLKPCVKLTPLCVTLNCINATNATASDSSILDGMKNCSFNITTE
LRDKREKKNALFYKLDIVQLGGNSSQYRLINCNTSVITQACPKVSFDPIPIHYCAPAGYAILKCNNKTFNGTGPCNN
VSTVQCTEGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLKKYFPDKNITFQPSSGGDLEITTHSFNCGGEFFYCNTSSLFNRTYMA
TSTDLANSTETNIITIHCRIKQIINMWQEVGRAMYAPPIAGNITCISNITGLLLTRDGGNNTEDTETFRPVGGNMKD
NWSSELYKYKVVEVKPLGVAPTNARRRVVKREKRAVGMAMFLGFLGAAGSTMGAASITLTVQARQLLSGIVQQQSN
LLKAIEAQQHMLKLTVWGIKQLQARVLALERYLKDQQLLGMWGCSGKLICTTNVYWNSSWSNKTYDDIWDNMTWMQW
EREISNYTELIYELLEESQNQQEKNEQDLLALDRWNSLWNWFNITNWLWYIKIFIMIVGGLIGLRIIFAVLSLVNRV
RQGYSPLSLQTLIPSPRGPDRPGGIEEEGGEQDRNRSTRLVSGFLALAWDDLRSLCLFIYHRLRDFILIAARAGELL
GRSSLKGLRRGWEALKYLGSLVQYWGLELKRSAISLLDTLAIAVGEGTDRILEFVLGICRAIRNIPTRIPQGFETAL
L*
>703010505.w160.C12
MRVMGRQRNYPQWWIWSMLGLWMLMICNGMWVTVYYGVPVWKEAKTTLFCASDAKGYEKEVHNVWATHACVPTDPNP
QEMVLKNVTENFNMWENDMVDQMHEDVISLWDQSLKPCVKLTPLCVTLNCTDANATASNANATVSNTNATVSNDSSI
IEEMKNCSFNITTELRDKIEKKYALFYKLDIVQLDGNSTHYRPINCNTSAITQACPKVSFDPIPIHYCAPAGYAILK
CNNKTFNGTGPCNNVSTVQCTHGIKPVVSTQLLLNGSLAEGEIIIRSKNITDNGKTIIVHLNESVKIECTRPSNNTR
TSIGIGPGQAFYATGQVIGDIRKAHCNISESKWNETLQRVSKKLKEYFPGKNITFQPSSGGDPEVTTHSFNCGGEFF
YCNTSSLFNRTYMTNSTDMANSTETNRTITIHCRIKQIINMWQEVGRAMYAPPIAGNITCISNITGLLLTRDGGNSS
TETETFRPEGGNMKDNWRSELYKYKVVEVKPLGVAPTNARRRVVEREKRAVGMGAVFLGFLGAAGSTMGAASITLTV
QARQLLSGIVQQQSNLLKAIEAQQHMLRLTVWGIKQLQARVLALERYLKDQQLLGMWGCSGKLICTTNVYWNSSWSN
KTYDDIWDNMTWMQWEGEISNYTNIIYDLLEESQNQQEKNEQDLLALDRWNSLWNWFNITKWLWYIKIFIMIVGGLI
GLRIIFAVLSLVNRVRQGYSPLSLQTLIPSPRGPDRPGGIEEEGGEQDRKRSTRLVSGFLALVWDDLRSLCLFLYHR
LRDFILIAARAGELLGRSSLKGLRRGWEALKYLGSLVQYWGLELKGSAISLLDTLAIAVGEGTDRILEFVLGICRAI
RNIPTRIRQGFETALL*
```

FIG. 17A cont'd

>703010505.w160.C14
MRVRGIQRSYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCINATNATDSKSNILEGMKNCSFNITTE
LRDKREKKNALFYKLDIVQLGSNSSQYRLINCNTSVITQACPKVSFDPIPIHYCAPAGYAILKCNNKTFNGTGPCNN
VSTVQCTHGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLKEYFPDKNITFQPSSGGDLEITTHSFNCGGEFFYCNTSSLFNRTYMA
NSTDMANSTETNSTQIITIHCRIKQIINMWQEVGRAMYAPPIAGNITCISNITGLLLTRDGGNNTEDTETFRPVGGN
MKDNWSSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYDDIWDNMTW
MQWEREISNYTNIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w160.C2
MRVRGIQRSYPQWWIWSMLGFWMLMICNGMWVTVYYGVPVWKEAKTTLFCASDAKAYEKEVHNVWATHACVPTDPNP
QEMVLKNVTENFNMWENDMVDQMHEDVISLWDQSLKPCVKLTPLCVTLNCINATNATASDSSILDGMKNCSFNITTE
LRDKREKKNALFYKLDIVQLGSNSSQYRLINCNTSVITQACPKVSFDPIPIHYCAPAGYAILKCNNKTFNGTGPCNN
VSTVQCTHGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLKEYFPDKKITFQPSSGGDLEITTHSFNCGGEFFYCNTSSLFNRTYMA
NSTDMANSTETNSTQIITIHCRIKQIINMWQEVGRAMYAPPIAGNITCISNITGLLLTRDGGNNTEDTETFRPVGGN
MKDNWSSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYDDIWDNMTW
MQWEREISNYTEIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w160.C3
MRVMGRQRSYPQWWIWSMLGLWMLMICNGMWVTVYYGVPVWKEAKTTLFCASDAKGYEKEVHNVWATHACVPTDPNP
QEMVLKNVTENFNMWENDMVDQMHEDVISLWDQSLKPCVKLTPLCVTLNCTDANATASNANATVSNTNATVSNDSSI
IEEMKNCSFNITTELRDKIEKKYALFYKLDIVQLDGNSTHYRFINCNTSAITQACPKVSFDPIPIHYCAPAGYAILK
CNNKTFNGTGPCNNVTTVQCTHGIKPVVSTQLLLNGSLAEGEIIIRSKNITDNGNTIIVHLNESVKIECTRPGNNTR
TSIRIGPGQAFYATGQVIGDIRQAHCNISESKWNETLQRVSEKLKEYFPNKTITFQPSSGGDPEVTTHSFNCGGEFF
YCNTSSLFNRTYMTNSTDMANSTETNRTITIHCRIKQIINMWQEVGRAMYAPPIAGNITCISNITGLLLTRDGGNNT
DPEIFRPGGGNMKDNWRSELYKYKVVEVKPLGVAPTNARRRVVEREKRAVGMGAVFLGFLGAAGSTMGAASITLTVQ
ARQLLSGIVQQQSNLLKAIEAQQHMLRLTVWGIKQLQARVLALERYLKDQQLLGMWGCSGKLICTTNVYWNSSWSNK
TYGDIWDNMTWMQWESEISNYTNIIYDLLEESQNQQEKNEQDLLALDRWNSLWNWFNITKWLWYIKIFIMIVGGLIG
LRIIFAVLSLVNRVRQGYSPLSLQTLIPSPRGPDRPGGIEEEGGEQDRKRSTRLVSGFLALVWDDLRSLCLPLYHRL
RDFTLIAARAGELLGRSSLKGLRRGWEALKYLGSLVQYWGLELKGSAISLLDTLAIAVGEGTDRILEFVLGICRAIR
NIPTRIRQGPETALL*
>703010505.w160.C4
MRVRGIQRSYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCINATNATDSKSNILEGMKNCSFNITTE
LRDKREKKNALFYKLDIVQLGGNSSQYRLINCNTSVITQACPKVSFDPIPIRYCAPAGYAILKCNNKTFNGTGPCNN
VSTVQCTHGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLKEYFPDKNITFQPSSGGDLEITTHSFNCGGEFFYCNTSSLFNRTYMA
NSTDMANSTETNSTQIITIHCRIKQIINMWQEVGRAMYAPPIAGNITCISNITGLLLTRDGGNNTEDTETFRPVGGN
MKDNWSSELYKYKVVEVKPLGVAPTKARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYDDIWDNMTW
MQWEREISNYTNIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w160.C5
MRVRGIQRNYPQWWIWSMLGFWMLMICNGMWVTVYYGVPVWKEAKTTLFCASDAKAYEKEVHNVWATHACVPTDPNP
QEMVLKNVTENFNMWENDMVDQMHEDVISLWDQSLKPCVKLTPLCVTLNCINATNATDSSILDGMKNCSFNITTE
LRDKREKKNALFYKLDIVQLGGNSSQYRLINCNTSVITQACPKVSFDPIPIHYCAPAGYAILKCNNKTFNGTGPCNN
VSTVQCTHGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLKKYFPDKNITFQPSSGGDLEITTHSFNCGGEFFYCNTSSLFNRTYMA
TSTDMANSTETNIITIHCRIKQIINMWQEVGRAMYAPPIAGNITCISNITGLLLTRDGGNNTEDTETFRPVGGNMKD
NWSSELYKYKVVEVKPLGVAPTNARRRVVEREKRAVGMGAVFLGFLGAAGSTMGAASITLTVQARQLLSGIVQQQSN
LLKAIEAQQHMLKLTVWGIKQLQARVLALERYLKDQQLLGMWGCSGKLICTTNVYWNSSWSNKTYSDIWDNMTWMQW
EREISNYTDMIYELLEESQNQQEKNEQDLLALDRWNSLWNWFNITNWLWYIKIFIMIVGGLIGLRIIFAVLSLVNRV
RQGYSPLSLQTLIPSPRGPDRPGGIEEEGGEQDRNRSTRLVSGFLALAWDDLRSLCLFIYHRLRDFILIAARAGELL
GRSSLKGLRRGWEALKYLGSLVQYWGLELKKSAISLLDTLAIAVGEGTDRILEFVLGICRAIRNIPTRIPQGFETAL
L*
>703010505.w160.C6
MRVRGIQRSYPQWWIWSMLGFWMLMICNGMWVTVYYGVPVWKEAKTTLFCASDAKAYEKEVHNVWATHACVPTDPNP
QEMVLKNVTENFNMWENDMVDQMHEDVISLWDQSLKPCVKLTPLCVTLNCINATNATASDSSILDGMKNCSFNITTE
LRDKREKKNALFYKLDIVQLGGNSSQYRLINCNTSVITQACPKVSFDPIPIHYCAPAGYAILKCNNKTFNGTGPCNN
VSTVQCTEGIKPVVSTQLLLNGSLAEGEIIIRSKNITDNSKTIIVHLNESVKIECTRPSNNTRTSIRIGPGQAFYAT

FIG. 17A cont'd

GQVIGNIREAHCNISESKWNETLQRVSKKLKEYFPDKNITFQPSSGGDLEITTHSFNCGGEFFYCNTSSLFNRTYMA
TSTDMANSTETNSTQIITIHCRIKQIINMWQEVGRAMYAPPIAGNITCISNITGLLLTRDGGNNTEGTETFRPVGGN
MKDNWSSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYSDIWDNMTW
MQWEREISNYTDMIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w160.C7
MRVRGIQRSYPQWWIWSMLGFWMLMICNGMWVTVYYGVPVWKEAKTTLFCASDAKAYEKEVHNVWATHACVPTDPNP
QEMVLKNVTENFNMWENDMVDQMHEDVISLWDQSLKPCVRLTPLCVTLNCINATNATASDSSILDGMKNCSFNITTE
LRDKREK#NALFYKLDIVQLGGNSSQYRLINCNTSVITQACPKVSFDPIPIHYCAPAGYAILKCNNKTFNGTGPCNN
VSTVQCTHEGIKPVVSTQLLLNGSLAEGEIIIRSKNITDNSKTIIVHLNESVKIECTRPSNNTRTSIRIGPGQAFYAT
GQVVGNIREAHCNISESKWNETLQRVSEKLKEYFPDKNITFQPSSGGDLEITTHSFNCGGEFFYCNTSSLFNRTYMA
NSTDMANSTETNSTQIITIHCRIKQIINMWQEVGRAMYAPPIAGNITCISNITGLLLTRDGGNNTEDTETFRPEGGN
MKDNWRSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYDDIWDNMTW
MQWEREISNYTNIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKGSAISLLDTLAIAVGEGTDRILEFVLGICRAIRNIPTRIRQGFE
TALL*
>703010505.w160.C9
MRVRGIQRSYPQWWIWSMLGFWMLMICNGMWVTVYYGVPVWKEAKTTLFCASDAKAYEKEVHNVWATHACVPTDPNP
QEMVLKNVTENFNMWENDMVDQMHEDVISLWDQSLKPCVRLTPLCVTLNCINATNATASDSSILDGMKNCSFNITTE
LRDKREKKNALFYKLDIVQLGSNSSQYRLINCNTSVITQACPKVSFDPIPIHYCAPAGYAILKCNNKTFNGTGPCNN
VSTVQCTHEGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLKEYFPDKNITFQPSSGGDLEITTHSFNCGGEFFYCNTSSLFNRTYMA
NSTDMANSTETNSTQIITIHCRIKQIINMWQEVGRAMYAPPIAGNITCISNITGLLLTRDGGNNTEDTETFRPVGGN
MKDNWSSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYDDIWDNMTW
MQWEREISNYTEIIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w160.D1
MRVRGIQRSYPQWWIWSMLGFWMLMICNGMWVTVYYGVPVWKEAKTTLFCASDAKAYEKEVHNVWATHACVPTDPNP
QEMVLKNVTENFNMWENDMVDQMHEDVISLWDQSLKPCVRLTPLCVTLNCINATNATASDSSILDGMKNCSFNITTE
LRDKREKKNALFYKLDIVQLGGNSSQYRLINCNTSVITQACPKVSFDPIPIHYCAPAGYAILKCNNKTFNGTGPCNN
VSTVQCTHEGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLKKYFPDKNITFQPSSGGDLEITTHSFNCGGEFFYCNTSSLFNRTYMA
TSTDMANSTETNIITIHCRIKQIINMWQEVGRAMYAPPIAGNITCISNITGLLLTRDGGNNTEDTETFRPVGGNMKD
NWSSELYKYKVVEVKPLGVAPTNARRRVVEREKRAVGMGAVFLGFLGAAGSTMGAASITLTVQARQLLSGIVQQQSN
LLKAIEAQQHMLKLTVWGIKQLQARVLALERYLKDQQLLGMWGCSGKLICTTNVYWNSSWSNKTYSDIWDNMTWMQW
EREISNYTDMIYELLEESQNQQEKNEQDLLALDRWNSLWNWFNITNWLWYIKIFIMIVGGLIGLRIIFAVLSLVNRV
RQGYSPLSLQTLIPSPRGPDRPGGIEEEGGEQDRNRSTRLVSGFLALAWDDLRSLCLFIYHRLRDFILIAARAGELL
GRSSLKGLRRGWEALKYLGSLVQYWGLELKRSAISLLDTLAIAVGEGTDRILEFVLGICRAIRNIPTRIRQGFETAL
L*
>703010505.w160.D2
MRVRGIQRSYPQWWIWSMLGFWMLMICNGMWVTVYYGVPVWKEAKTTLFCASDAKAYEKEVHNVWATHACVPTDPNP
QEMVLKNVTENFNMWENDMVDQMHEDVISLWDQSLKPCVRLTPLCVTLNCINATNATASDSSILDGMKNCSFNITTE
LRDKREKKNALFYKLDIVQLGGNSSQYRLINCNTSVITQACPKVSFDPIPIHYCAPAGYAILKCNNKTFNGTGPCNN
VSTVQCTHEGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLKKYFPDKNITFQPSSGGDLEITTHSFNCGGEFFYCNTSSLFNRTYMA
TSTDMANSTETNIITIHCRIKQIINMWQEVGRAMYAPPIAGNITCISNITGLLLTRDGGNNTEDTETFRPVGGNMKD
NWSSELYKYKVVEVKPLGVAPTNARRRVVEREKRAVGMGAVFLGFLGAAGSTMGAASITLTVQARQLLSGIVQQQSN
LLKAIEAQQHMLKLTVWGIKQLQARVLALERYLKDQQLLGMWGCSGKLICTTNVYWNSSWSNKTYDDIWDNMTWMQW
EREISNYTEIIYDLLEESQNQQEKNEQDLLALDRWNSLWNWFNITNWLWYIKIFIMIVGGLIGLRIIFAVLSLVNRV
RQGYSPLSLQTLIPSPRGPDRPGGIEEEGGEQDRNRSTRLVSGFLALAWDDLRSLCLFIYHRLRDFILIAARAGELL
GRSSLKGLRRGWEALKYLGSLVQYWGLELKRSAISLLDTLAIAVGEGTDRILEFVLGICRAIRNIPTRIRQGFETAL
L*
>703010505.w160.D5
MRVRGIQRSYPQWWIWSMLGFWMLMICNGMWVTVYYGVPVWKEAKTTLFCASDAKAYEKEVHNVWATHACVPTDPNP
QEMVLKNVTENFNMWENDMVDQMHEDVISLWDQSLKPCVRLTPLCVTLNCINATNATASDSSILDGMKNCSFNITTE
LRDKREKKNALFYKLDIVQLGSNSSQYRLINCNTSVITQACPKVSFDPIPIHYCAPAGYAILKCNNKTFNGTGPCNN
VSTVQCTEGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLKEYFPDKNITFQPSSGGDLEITTHSFNCGGEFFYCNTSSLFNRTYMA
NSTDMANSTETNSTQIITIHCRIKQIINMWQEVGRAMYAPPIAGNITCISNITGLLLTRDGGNNTEDTETFRPVGGN
MKDNWSSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLICTTNVYWNSSWSNKTYDDIWDNMTW
MQWEREISNYTEIIYELLEESQNQQEKNEQDLLALDRWNSLWNWFNITNWLWYIKIFIMIVGGLIGLRIIFAVLSLV

FIG. 17A cont'd

NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w160.D6
MRVKGIQRNYPQWWIWSMLGFWMLMICNGMWVTVYYGVPVWKEAKTTLFCASDAKAYEKEVHNVWATHACVPTDPNP
QEMVLKNVTENFNMWENDMVDQMHEDVISLWDQSLKPCVKLTPLCVTLNCINATNTTDSNSNILEGMKNCSFNITTE
LRDKREKKNALFYKLDIVQLCGNSSGNSSQYRLINCNTSVITQACPKVSFDPIPIHYCAPAGYAILKCNNKTFNGTG
PCNNVSTVQCTHGIKPVVSTQLLLNGSLAEGKIIIRSKNITDNSKTIIVHLNESVKIECTRPSNNTRTSIRIGPGQA
FYATGQVIGNIREAHCNISESKWNETLQRVSEKLKKYFPDKNITFQPSSGGDLEITTHSFNCGGEFFYCNTSSLFNR
TYMATSTDMANSTETNIITIHCRIKQIINMWQEVGRAMYAPPIAGNITCISNITGLLLTRDGGNNTEDTETFRPVGG
NMKDNWSSELYKYKVVEVKPLGVAPTNARRRVVEREKRAVGMGAVFLGFLGAAGSTMGAASITLTVQARQLLSGIVQ
QQSN#LKAIEAQQHMLKLTVWGIKQLQARVLALERYLKDQQLLGMWGCSGKLICTTNVYWNSSWSNKTYDDIWDNMT
WMQWEREISNYTNIIYELLEESQNQQEKNEQDLLALDRWNSLWNWFNITNWLWYIKIFIMIVGGLIGLRIIFAVLSL
VNRVRQGYSPLSLQTLIPSPRGPDRPGGIEEEGGEQDRNRSTRLVSGFLALAWDDLRSLCLFIYHRLRDFILIAARA
GELLGRSSLKGLRRGWEALKYLGSLVQYWGLELKRSAISLLDTLAIAVGKGTDRILEFVLGICRAIRNIPTRIRQGF
ETALL*
>703010505.w160.T2
MRVRGIQRSYPQWWIWSMLGFWMLMICNGMWVTVYYGVPVWKEAKTTLFCASDAKAYEKEVHNVWATHACVPTDPNP
QEMVLKNVTENFNMWKNDMVDQMHEDVISLWDQSLKPCVKLTPLCVTLNCINATNATASDSSILDGMKNCSFNITTE
LRDKREKKNALFYKLDIVQLGGNSSQYRLINCNTSVITQACPKVSFDPIPIHYCAPAGYAILXCNNKTFNGTGPCNN
VSTVQCTHGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLKEYFPDKNITFQPSSGGDLEITTHSFNCGGEFFYCNTSSLFNRTYMA
NSTDMANSTETNSTQIITIHCRIKQIINMWQEVGRAMYAPPIAGNITCISNITGLLLTRDGGNNTEDTETFRPVGGN
MKDNWSSELYKYKVVEVKPLGVAPTNARRRVVEREKRAVGMGAVFLGFLGAAGSTMGAASITLTVQARQLLSGIVQQ
QSNLLKAIEAQQHMLKLTVWGIKQLQARVLALERYLKDQQLLGMWGCSGKLTCTTNVYWNSSWSNKTYSDIWDNMTW
MQWEREISNYTDMIYELLEESQNQQEKNEQDLLALDRWNSLWNWFNITNWLWYIKIFIMIVGGLIGLRIIFAVLSLV
NRVRQGYSPLSLQTLIPSPRGPDRPGGIEEEGGEQDRNRSTRLVSGFLALAWDDLRSLCLFIYHRLRDFILIAARAG
ELLGRSSLKGLRRGWEALKYLGSLVQYWGLELKRSAISLLDTLAIAVGEGTDRILEFVLGICRAIRNIPTRIRQGFE
TALL*
>703010505.w160.T3
MRVRGIQRSYPQWWIWSMLGFWMLMICNGMWVTVYYGVPVWKEAKTTLFCASDAKAYEKEVHNVWATHACVPTDPNP
QEMVLKNVTENFNMWENDMVDQMHEDVISLWDQSLKPCVKLTPLCVTLNCINATNATASDSSILDGMKNCSFNITTE
LRDKREKKNALFYKLDIVQLGGNSSQYRLINCNTSVITQACPKVSFDPIPIHYCAPAGYAILXCNNKTFNGTGPCNN
VSTVQCTHGIKPVVSTQLLLNGSLAEGEIIIRSKNITDNSKTIIVHLNESVKIECTRPSNNTRTSIRIGPGQAFYAT
GQVIGNIREAHCNISESKWNETLQRVSEKLKKYFPDKNITFPRSSGGDLEITTHSFNCGGEFFYCNTSSLFNRTYMA
TSTDMANSTETNIITIHCRIKQIINMWQEVGRAMYAPPIAGNITCISNITGLLLTRDGGNNTEDTETFRPVGGNMKD
NWSSELYKYKVVEVKPLGVAPTNARRRVVEREKRAVGMGAVFLGFLGAAGSTMGAASITLTVQARQLLSGIVQQQSN
LLKAIEAQQHMLKLTVWGIKQLQARVLALERYLKDQQLLGMWGCSGKLICTTNVYWNSSWSNKTYDDIWDNMTWMQW
EREISNYTELIYELLEESQNQQEKNEQDLLALDRWNSLWNWFNITNWLWYIKIFIMIVGGLIGLRIIFAVLSLVNRV
RQGYSPLSLQTLIPSPRGPDRPGGIEEEGGEQDRNRSTRLVSGFLALAWDDLRSLCLFIYHRLRDFILIAARAGELL
GRSSLKGLRRGWEALKYLGSLVQYWGLELKRSAISLLDTLAIAVGEGTDRILEFVLGICRAIRNIPTRIRQGFETAL
L*
>703010505.w160.T4
MRVMGRQRNYPQWWIWSTLGLRMLMICNGMWVTVYYGVPVWKEAKTTLFCASDAKAYEKEVHNVWATHACVPTDPNP
QEMVLKNVTENFNMWENDMVDQMHEDVISLWDQSLKPCVKLTPLCVTLNCTDANATASNANATVSNTNATVSNDSSI
IEEMKNCSFNITTELRDKIEKKYALFYKLDIVQLDGNSTHYRFINCNTSAITQACPKVSFDPIPIHYCAPAGYAILK
CNNKTFNGTGPCNNVSTVQCTHGIKPVVSTQLLLNGSLAEGEIIIRSENITDNAKTIIVHLNESVKIECTRPSNNTE
TSIGIGPGQAFYATGQVIGDIRKAHCNISESKWNETLQRVSEKLKEYFPGKNITFQPSSGGDPEVTTHSFNCGGEFF
YCNTSSLFNRTYMTSTDMANSTETNRTITIHCRIKQIINMWQEVGRAMYAPPIAGNITCISNITGLLLTRDGGNNT
DPEIFRPGGGNMKDNWRSELYKYKVVEVKPLGVAPTNARRRVVEREKPAVGMGAVFLGFLGAAGSTMGAASITLTVQ
ARQLLSGIVQQQSNLLKAIEAQQHMLRLTVWGIKQLQARVLALERYLKDQQLLGMWGCSGKLICTTNVYWNSSWSNK
TYGDIWDNMTWMQWESEISNYTNIIYDLLEESQNQQEKNEQDLLALDRWNSLWNWFNITKNLWYIKIFIMVGGLIG
LRIIFAVLSLVNRVRQGYSPLSLQTLIPSPRGPDRPGGIEEEGGEQDRKRSTRLVSGFLALVWDDLRSLCLFLYHRL
RDFILIAARAGELLGRSSLKGLRRGWEALKYLGSLVQYWGLELKRSAISLLDTLAIAVGEGTDRILEFVLGICRAIR
NIPTRIRQGFETALL*

FIG. 17B

>703010505.TF
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTCTATTGCAATACATCAAGCCTGTTTAATAGGACATATATGGCTAATAGTACA
GATATGGCTAATAGTACAGAAACTAACAGTACACGAACCATCCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAACAATACGCAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATTGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.31
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACCACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTCTATTGCAATACATCAAGCCTGTTTAATAGGACATATATGGCTAATAGTACA
GAAACTAACAGTACACGAACCATCACAATCCACTGCAGAATAAAACAAATTATAAACATGTGCAGGAGGTGGGACC
AGCAATGTATGCCCCTCCCATTGCAGGAAACATAACATGTATATCAAATATCACAGGACTACTATTGACAAGGGATG
GAGGAAAAACAATACGGAGACATTCAGACCTGGAGGAGGAAATATGAAGGACAATTGGAGAAGTGAATTATATAAA
TATAAAGTGGTAGAAGTTAAGCCATTAGGAGTAGCACCCACTAATGCAAGAAGGAGAGTGGTGGAGAGAGAAAAAG
AGCAGTGGGAATGGGAGCTGTGTTCCTTGGGTTCTTGGGAGCGGCAGGAAGCACTATGGGCGCAGCATCAATAACGC
TGACGGTACAGGCCAGACAATTATTGTCTGGTATAGTGCAACAGCAAAGCAATTTGCTGAAGGCTATAGAGGCTCAA
CAGCATATGTTGAAACTCACGGTCTGGGGCATTAAACAGCTCCAGGCAAGAGTCCTGGCCTTGGAAAGATACCTAAA
GGATCAACAGCTCCTAGGGATGTGGGGCTGCTCTGGAAAACTCATCTGCACCACTAATGTATATTGGAACTCTAGTT
GGAGTAATAAAACTTATGGTGATATTTGGGATAACATGACCTGGATGCAGTGGGAGAGAGAAATTAGCAATTATACA
GAAATAATATATGAATTGCTTGAAGAATCACAAAACCAGCAGGAAAAGAATGAACAAGATTTACTAGCATTGGACAG
ATGGAACAGTCTGTGGAATTGGTTTAACATAACAAATTGGCTGTGGTATATAAAAATATTCATAATGATAGTAGGAG
GCTTGATAGGTTTAAGAATAATTTTTGCTGTGCTTTCTTTAGTAAATAGAGTTAGGCAGGGATACTCACCTCTGTCG
TTGCAGACCCTTATCCCAAGCCCGAGGGGACCAGACAGGCCCGGAGGAATCGAAGAAGAAGGTGGAGAGCAAGACAG
AAACAGATCAACGCGATTAGTGAGCGGATTCTTAGCGCTTGTCTGGGACGACCTGCGGAGCCTGTGCCTTTTCATCT
ACCACCGATTGAGAGACTTCATATTAATTGCAGCGAGAGCGGGGAACTTCTGGGACGCAGCAGTCTCAAGGGACTA
CGGAGAGGATGGGAAGCCCTAAGTATCTGGGAAGTCTTGTGCAGTATTGGGGCCTGGAACTAAAAAGGAGTGCTAT
TAGTCTATTGGATACCCTAGCAATAGCAGTAGGTGAAGGAACAGATAGGATTCTAGAATTTGTATTAGGAATTTGTA
GAGCTATCCGCAACATACCTACAAGAATAAGACAGGGCTTTGAAACAGCTTTGCTATAA
>703010505.W4.27

FIG. 17B cont'd

```
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GAAACTAACAGTACACGAACCATCACAATCCACTGCAGAATAAAACAAATTATAAACATGTGGCAGGAGGTGGGACG
AGCAATGTATGCCCCTCCCATTGCAGGAAACATAACATGTATATCAAATATCACAGGACTACTATTGACAAGGGATG
GAGGAAAAAACAATACGGAGACATTCAGACCTGGAGGAGGAAATATGAAGGACAATTGGAGAAGTGAATTATATAAA
TATAAAGTGGTAGAAGTTAAGCCATTAGGAGTAGCACCCACTAATGCAAGAAGGAGAGTGGTGGAGAGAGAAAAAAG
AGCAGTGGGAATGGGAGCTGTGTTCCTTGGGTTCTTGGGAGCGGCAGGAAGCACTATGGGCGCAGCATCAATAACGC
TGACGGTACAGGCCAGACAATTATTGTCTGGTATAGTGCAACAGCAAAGCAATTTGCTGAAGGCTATAGAGGCTCAA
CAGCATATGTTGAAACTCACGGTCTGGGGCATTAAACAGCTCCAGGCAAGAGTCCTGGCCTTGGAAAGATACCTAAA
GGATCAACAGCTCCTAGGGATGTGGGCTGCTCTGGAAAACTCATCTGCACCACTAATGTATATTGGAACTCTAGTT
GGAGTAATAAAACTTATGGTGATATTTGGGATAACATGACCTGGATGCAGTGGGAGAGAGAAATTAGCAATTATACA
GAAATAATATATGAATTGCTTGAAGAATCACAAAACCAGCAGGAAAAGAATGAACAAGATTTACTAGCATTGGACAG
ATGGAACAGTCTGTGGAATTGGTTTAACATAACAAATTGGCTGTGGTATATAAAAATATTCATAATGATAGTAGGAG
GCTTGATAGGTTTAAGAATAATTTTTGCTGTGCTTTCTTTAGTAAATAGAGTTAGGCAGGGATACTCACCTCTGTCG
TTGCAGACCCCTTATCCCAAGCCCGAGGGGACCAGACAGGCCCGGAGGAATCGAAGAAGAAGGTGGAGACAAGACAG
AAACAGATCAACGCGATTAGTGAGCGGATTCTTAGCGCTTGTCTGGGACGACCTGCGGAGCCTGTGCCTTTTCATCT
ACCACCGATTGAGAGACTTCATATTAATTGCAGCGAGAGCGGGGGAACTTCTGGGACGCAGCAGTCTCAAGGGACTA
CGGAGAGGATGGGAAGCCCTTAAGTATCTGGGAAGTCTTGTGCAGTATTGGGGCCTGGAACTAAAAAGGAGTGCTAT
TAGTCTATTGGATACCCTAGCAATAGCAGTAGGTGAAGGAACAGATAGGATTCTAGAATTTGTATTAGGAATTTGTA
GAGCTATCCGCAACATACCTACAAGAATAAGACAGGGCTTTGAAACAGCTTTGCTATAA
>703010505.W4.03
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACGCATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGCATTAAACAGCTCCAGGCAAGAGTCCTGGCC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGGGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.51
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
```

FIG. 17B cont'd

CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCTTACCAGAAGGAGAGAT
AATAATTAGATCTGAAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCGAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.19
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
CGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCTTACCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGATAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.46
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA

FIG. 17B cont'd

CGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAAGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.44
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAAATTTCAACATGTGGAAAAATGACATGGTGGATCAGATGCATGAAGA
CGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.43
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAAATTTCAACATGTGGAAAAATGACATGGTGGATCAGATGCATGAAGA
CGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT

FIG. 17B cont'd

```
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGACGACAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.21
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
CGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.49
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
```

FIG. 17B cont'd

```
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAGGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.23
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAGGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.04
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
```

FIG. 17B cont'd

```
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTGCTATAA
>703010505.W4.28
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTGCTATAA
>703010505.W4.48
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
```

FIG. 17B cont'd

ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.52
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.33
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA

FIG. 17B cont'd

```
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACTGCAGAATAAAACAAATTTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.18
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACTGCAGAATAAAACAAATTTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.20
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
```

FIG. 17B cont'd

```
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCCACCGATTGAGAGACTTCATATTAATTGCAGCGAGACGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703016505.W4.34
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAGAAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCCACCGATTGAGAGACTTCATATTAATTGCAGCGAGACGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703016505.W4.55
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAGAAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
```

FIG. 17B cont'd

```
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.4S
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAATTTTTCTATTGCAATACATCAAGCCTGTTTAATAGGACATATATGGCTAATAGTACA
GATATGGCTAATAGTACAGAAACTAACAGTACACGAACCATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.2S
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAATTTTTCTATTGCAATACATCAAGCCTGTTTAATAGGACATATATGGCTAATAGTACA
GATATGGCTAATAGTACAGAAACTAACAGTACACGAACCATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
```

FIG. 17B cont'd

```
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.02
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.24
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
```

FIG. 17B cont'd

```
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.42
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGTTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.59
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
```

FIG. 17B cont'd

GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGACGGAGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.39
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.22
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT

FIG. 17B cont'd

TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.05
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.32
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA

FIG. 17B cont'd

```
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.40
ATGAGAGTGATGGGGATACGAGGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.16
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
```

FIG. 17B cont'd

```
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010905.W4.14
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGAGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010905.W4.41
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAACAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
```

FIG. 17B cont'd

ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.11
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AAGAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACAGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.09
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGTAAAAATTGCTCTTTCAATATAACCACAGAATTAAGAGAT
AAGAGAGAGAAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACAGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA

FIG. 17B cont'd

>703010505.W4.37
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTGCACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCCAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAGAATTTGTAGAGCTATCCGCAACATACCTACAAGAATAAGACAGGGCTTTGAAACAGCTTTGCTATAA
>703010505.W4.12
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGGGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCCAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAGAATTTGTAGAGCTATCCGCAACATACCTACAAGAATAAGACAGGGCTTTGAAACAGCTTTGCTATAA
>703010505.W4.50

FIG. 17B cont'd

```
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGCCTAGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.13
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACACATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.56
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
```

FIG. 17B cont'd

```
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTCGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGAAATTTGTAGAGCTATCCGCAACATACCTACAAGAATAAGACAGGGCTTTGAAACAGCTTTGCTATAA
>703010505.W4.26
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGTAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTCGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGAAATTTGTAGAGCTATCCGCAACATACCTACAAGAATAAGACAGGGCTTTGAAACAGCTTTGCTATAA
>703010505.W4.29
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
```

FIG. 17B cont'd

```
TGTAATTAGTTTATGGGATCAAAGCCTCAAGCCATGTGTAAAGTTGACCCCACTCTGTGTCACTCTAAACTGTACCA
ATGCTACTGCCAGCAATAGCCAGTATAATAGAGGGAATGAAAAATTGCTCTTTCAATATAACCACAGAATTAAGAGAT
AAGAGAGAGAAAAAGAAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>7S3010505.W4.07
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCCAGTATAATAGAGGGAATGAAAAATTGCTCTTTCAATATAACCACAGAATTAAGAGAT
AAGAGAGAGAAAAAGAATGCACTTTTTTATAAGCTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>7S3010505.W4.35
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCCAGTATAATAGAGGGAATGAAAAATTGCTCTTTCAATATAACCACAGAATTAAGAGAT
```

FIG. 17B cont'd

```
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTCTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTACAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.54
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.10
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
```

FIG. 17B cont'd

```
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.47
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.61
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
```

FIG. 17B cont'd

AATAATTAGATCTGAAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.18
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCACAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W4.06
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCACAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGTGTAATAATGTCAGCACAGTAC
AATGTACACATGGAATTAAGCCAGTGATTTCAACTCAACTATTGTTAAATGGTAGCCTAGCAGAAGGAGAGATAATA
ATTAGATCTGAAAATATAACAAACAATGTCAAAACAATAATAGTACATCTCAATGAATCTGTAAAGATTGAGTGTAC
GAGACCCAATAATAAAACAAGAACAAGTATAAGAATAGGACCAGGACAAGCATTTTATGCAACAGGACAAGTAATAG

FIG. 17B cont'd

GAGACATAAGAGAAGCATATTGTAACATTAATGAAAGTAAATGGAATGAAACTTTACAAAGGGTAAGTAAAAAATTA
AAAGAATACTTCCCTCATAAGAATATAACATTTCAACCATCCTCAGGAGGGGACCTAGAAATTACAACACATAGCTT
TAATTGTGGAGGAGAATTTTTCTATTGCAATACATCAAGCCTGTTTAATAGGACATATATGGCTAATAGTACAGATA
TGGCTAATAGTACAGAAACTAACAGTACACGAACCATCACAATCCACTGCAGAATAAAACAAATTATAAACATGTGG
CAGGAGGTGGGACGAGCAATGTATGCCCCTCCCATTGCAGGAAACATAACATGTATATCAAATATCACAGGACTACT
ATTGACAAGGGATGGAGGAAAAAACAATACGGAGACATTCAGACCTGGAGGAGGAAATATGAAGGACAATTGGAGAA
GTGAATTATATAAATATAAAGTGGTAGAAGTTAAGCCATTAGGAGTAGCACCCACTAATGCAAGAAGGAGAGTGGTG
GAGAGAGAAAAAGAGCAGTGGGAATGGGAGCTGTGTTCCTTGGGTTCTTGGGAGCGGCAGGAAGCACTATGGGCGC
AGCATCAATAACGCTGACGGTACAGGCCAGACAATTATTGTCTGGTATAGTGCAACAGCAAAGCAATTTGCTGAAGG
CTATAGAGGCTCAACAGCATATGTTGAAACTCACGGTCTGGGGCATTAAACAGCTCCAGGCAAGAGTCCTGGCCTTG
GAAAGATACCTAAAGGATCAACAGCTCCTAGGGATGTGGGCTGCTCTGGAAAACTCATCTGCACCACTAATGTATA
TTGGAACTCTAGTTGGAGTAATAAAACTTATGGTGATATTTGGGATAACATGACCTGGATGCAGTGGGAGAGAGAAA
TTAGCAATTATACAGAAATAATATATGAATTGCTTGAAGAATCACAAAACCAGCAGGAAAAGAATGAACAAGATTTA
CTAGCATTGGACAGATGGAACAGTCTGTGGAATTGGTTTAACATAACAAATTGGCTGTGGTATATAAAAATATTCAT
AATGATAGTAGGAGGCTTGATAGGTTTAAGAATAAATTTTTGCTGTGCTTTCTTTAGTAAATAGAGTTAGGCAGGGAT
ACTCACCTCTGTCGTTGCAGACCCTTATCCCAAGCCCGAGGGGACCAGACAGGCCCGAGGAATCGAAGAAGAAGGT
GGAGAGCAAGACAGAAACAGATCAACGCGATTAGTGAGCGGATTCTTAGCGCTTGTCTGGGACGACCTGCGGAGCCT
GTACCTTTTCATCTACCACCGATTGAGAGACTTCATATTAATTGCAGCGAGAGCGGGGGAACTTCTGGGACGCAGCA
GTCTCAAGGGACTACGGAGAGGATGGGAAGCCCTTAAGTATCTGGGAAGTCTTGTGCAGTATTGGGGCCTGGAACTA
AAAAGGAGTGCTATTAGTCTATTGGATACCCTAGCAATAGCAGTAGGTGAAGGAACAGATAGGATTCTAGAATTTGT
ATTAGGAATTTGTAGAGCTATCCGCAACATACCTACAAGAATAAGACAGGGCTTTGAAACAGCTTTGCTATAA
>703010505.W4.08
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGTACAGATATGGCTAATAGTACA
GAAACTAACAGTACACGAACCATCACAATCCACTGCAGAATAAAACAAATTATAAACATGTGGCAGGAGGTGGGACG
AGCAATGTATGCCCCTCCCATTGCAGGAAACATAACATGTATATCAAATATCACAGGACTACTATTGACAAGGGATG
GAGGAAAAAACAATACGGAGACATTCAGACCTGGAGGAGGAAATATGAAGGACAATTGGAGAAGTGAATTATATAAA
TATAAAGTGGTAGAAGTTAAGCCATTAGGAGTAGCACCCACTAATGCAAGAAGGAGAGTGGTGGAGAGAGAAAAAG
AGCAGTGGGAATGGGAGCTGTGTTCCTTGGGTTCTTGGGAGCGGCAGGAAGCACTATGGGCGCAGCATCAATAACGC
TGACGGTACAGGCCAGACAATTATTGTCTGGTATAGTGCAACAGCAAAGCAATTTGCTGAAGGCTATAGAGGCTCAA
CAGCATATGTTGAAACTCACGGTCTGGGGCATTAAACAGCTCCAGGCAAGAGTCCTGGCCTTGGAAAGATACCTAAA
GGATCAACAGCTCCTAGGGATGTGGGCTGCTCTGGAAAACTCATCTGCACCACTAATGTATATTGGAACTCTAGTT
GGAGTAATAAAACTTATGGTGATATTTGGGATAACATGACCTGGATGCAGTGGGAGAGAGAAATTAGCAATTATACA
GAAATAATATATGAATTGCTTGAAGAATCACAAAACCAGCAGGAAAAGAATGAACAAGATTTACTAGCATTGGACAG
ATGGAACAGTCTGTGGAATTGGTTTAACATAACAAATTGGCTGTGGTATATAAAAATATTCATAATGATAGTAGGAG
GCTTGATAGGTTTAAGAATAAATTTTTGCTGTGCTTTCTTTAGTAAATAGAGTTAGGCAGGGATACTCACCTCTGTCG
TTGCAGACCCTTATCCCAAGCCCGAGGGGACCAGACAGGCCCGAGGAATCGAAGAAGAAGGTGGAGAGCAAGACAG
AAACAGATCAACGCGATTAGTGAGCGGATTCTTAGCGCTTGTCTGGGACGACCTGCGGAGCCTGTGCCTTTTCATCT
ACCACCGATTGAGAGACTTCATATTAATTGCAGCGAGAGCGGGGGAACTTCTGGGACGCAGCAGTCTCAAGGGACTA
CGGAGAGGATGGGAAGCCCTTAAGTATCTGGGAAGTCTTGTGCAGTATTGGGGCCTGGAACTAAAAAGGAGTGCTAT
TAGTCTATTGGATACCACTAGCAATAGCAGTAGGTGAAGGAACAGATAGGATTCTAGAATTTGTATTAGGAATTTGTA
GAGCTATCCGCAACATACCTACAAGAATAAGACAGGGCTTTGAAACAGCTTTGCTATAA
>703010505.W4.38
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAAATAGTACATCTCAATGAATCTGTAAAGATTGAGTGTACGAGACCCAATAATAAAA
CAAGAACAAGTATAAGAATAGGACCAGGACAAGCATTTTATGCAACAGGACAAGTAATAGGAGACATAAGAGAAGCA
TATTGTAACATTAATGAAAGTAAATGGAATGAAACTTTACAAAGGGTAAGTAAAAAATTAAAAGAATACTTCCCTCA
TAAGAATATAACATTTCAACCATCCTCAGGAGGGGACCTAGAAATTACAACACATAGCTTTAATTGTGGAGGAGAAT

FIG. 17B cont'd

```
TTTTCTATTGCAATACATCAAGCCTGTTTAATAGGACATATATGGCTAATAGTACAGATATGGCTAATAGTACAGAA
ACTAACAGTACACGAACCATCACAATCCACTGCAGAATAAAACAAATTATAAACATGTGGCAGGAGGTGGGACGAGC
AATGTATGCCCCTCCCATTGCAGGAAACATAACATGTATATCAAATATCACAGGACTACTATTGACAAGGGATGGAG
GAAAAAACAATACGGAGACATTCAGACCTGGAGGAGGAAATATGAAGGACAATTGGAGAAGTGAATTATATAAATAT
AAAGTGGTAGAAGTTAAGCCATTAGGAGTAGCACCCACTAATGCAAGAAGGAGAGTGGTGGAGAGAGAAAAAAGAGC
AGTGGGAATGGGAGCTGTGTTCCTTGGGTTCTTGGGAGCGGCAGGAAGCACTATGGGCGCAGCATCAATAACGCTGA
CGGTACAGGCCAGACAATTATTGTCTGGTATAGTGCAACAGCAAAGCAATTTGCTGAAGGCTATAGAGGCTCAACAG
CATATGTTGAAACTCACGGTCTGGGGCATTAAACAGCTCCAGGCAAGAGTCCTGGCCTTGGAAAGATACCTAAAGGA
TCAACAGCTCCTAGGGATGTGGGGCTGCTCTGGAAAACTCATCTGCACCACTAATGTATATTGGAACTCTAGTTGGA
GTAATAAAACTTATGGTGATATTTGGGATAACATGACCTGGATGCAGTGGGAGAGAGAAATTAGCAATTATACAGAA
ATAATATATGAATTGCTTGAAGAATCACAAAACCAGCAGGAAAAGAATGAACAAGATTTACTAGCATTGGACAGATG
GAACAGTCTGTGGAATTGGTTTAACATAACAAATTGGCTGTGGTATATAAAAATATTCATAATGATAGTAGGAGGCT
TGATAGGTTTAAGAATAATTTTTGCTGTGCTTTCTTTAGTAAATAGAGTTAGGCAGGGATACTCACCTCTGTCGTTG
CAGACCCTTATCCCAAGCCCGAGGGGACCAGACAGGCCCGGAGGAATCGAAGAAGAAGGTGGAGAGCAAGACAGAAA
CAGATCAACGCGATTAGTGAGCGGATTCTTAGCGCTTGTCTGGGACGACCTGCGGAGCCTGTGCCTTTTCATCTACC
ACCGATTGAGAGACTTCATATTAATTGCAGCGAGAGCGGGGGAACTTCTGGGACGCAGCAGTCTCAAGGGACTACGG
AGAGGATGGGAAGCCCTTAAGTATCTGGGAAGTCTTGTGCAGTATTGGGGCCTGGAACTAAAAGGAGTGCTATTAG
TCTATTGGATACCCTAGCAATAGCAGTAGGTGAAGGAACAGATAGGATTCTAGAATTTGTATTAGGAATTTGTAGAG
CTATCCGCAACATACCTACAAGAATAAGACAGGGCTTTGAAACAGCTTTGCTATAA
>703010505.W7.6
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAAATGTAACAGAAAATTTCAACATGTGGAAAAATGACATGGTGGATCAGATGCATGAAG
ATGTAATTAGTTTATGGGATCAAAGCCTCAAGCCATGTGTAAAGTTGACCCCACTCTGTGTCACTCTAAACTGTACC
AATGCTACTGCCAGCAATAGCAGTATAATAGAGGGAATGAAAAATTGCTCTTTCAATATAACCACAGAATTAAGAGA
TAGGAGAGAGAAAAAGAATGCACTTTTTTTATAAACTTGATATAGTACAACTAGATGGCAACTCTAGTCAGTATAGAT
TAATAAAATTGTAATACCTCAGTCATAACACAAGCCTGTCCAAAGGTCTCTTTTGACCCAATTCCTATACATTATTGT
GCTCCAGCTGGTTATGCGATTCTAAAGTGTAATAATAAGACATTCACTGGAACAGGACCGTGTAATAATGTCAGCAC
AGTACAATGTACACATGGAATTAAGCCAGTGGTTTCAACTCAACTATTGTTAAATGGTAGCCTAGCAGAAGGAGAGA
TAATAATTAGATCTGAAAATATAACAAAAAATGTCAAAACAATAATAGTACATCTCAATGAATCTGTAAAGATTGAG
TGTACGAGACCCAATAATAAAACAAGAACAAGTATAAGAATAGGACCAGGACAAGCATTTTATGCAACAGGACAAGT
AATAGGAGACCATAAGAGAAGCATATTGTAACATTAATGAAAGTAAATGGAATGAAACTTTTACAAAGGGTAAGTAAAA
AATTAAAAGAATACTTCCCTCATAAGAATATAACATTTCAACCATCCTCAGGAGGGGACCTAGAAATTACAACACAT
AGCTTTAATTGTGGAGGAGAATTTTTCTATTGCAATACATCAAGCCTGTTTAATAGGACATATATGGCTAATAGTAC
AGATATGGCTAATAGTACAGAAACTAACAGTACACGAACCATCACAATCCGCTGCAGAATAAAACAAATTATAAACA
TGTGGCAGGAGGTGGGGAGCAATGTATGCCCCTCCCATTGCAGGAAACATAACATGTATATCAAATATCACAGGA
CTACTATTGACAAGGGATGGAGGAAAAAACAATACGGAGACATTCAGACCTGGAGGAGGAAATATGAAGGACAATTG
GAGAAGTGAATTATATAAATATAAAGTGGTAGAAGTTAAGCCATTAGGAGTAGCACCCACTAATGCAAGAAGGAGAG
TGGTGGAGAGAGAAAAAGAGCAGTGGGAATGGGAGCTGTGTTCCTTGGGTTCTTGGGAGCGGCAGGAAGCACTATG
GGCGCAGCATCAATAACGCTGACGGTACAGGCCAGACAATTATTGTCTGGTATAGTGCAACAGCAAAGCAATTTGCT
GAAGGCTATAGAGGCTCAACAGCATATGTTGAAACTCACGGTCTGGGGCATTAAACAGCTCCAGGCAAGAGTCCTGG
CCTTGGAAAGATACCTAAAGGATCAACAGCTCCTAGGGATGTGGGGCTGCTCTGGAAAACTCATCTGCACCACTAAT
GTATATTGGAACTCTAGTTGGAGTAATAAAACTTATGGTGATATTTGGGATAACATGACCTGGATGCAGTGGGAGAG
AGAAATTAGCAATTATACAGAAATAATATATGAATTGCTTGAAGAATCACAAAACCAGCAGGAAAAGAATGAACAAG
ATTTACTAGCATTGGACAGATGGAACAGTCTGTGGAATTGGTTTAACATAACAAATTGGCTGTGGTATATAAAAATA
TTCATAATGATAGTAGGAGGCTTGATAGGTTTAAGAATAATTTTTGCTGTGCTTTCTTTAGTAAATAGAGTTAGGCA
GGGATACTCACCTCTGTCGTTGCAGACCCTTATCCCAAGCCCGAGGGGACCAGACAGGCCCGGAGGAATCGAAGAAG
AAGGTGGAGAGCAAGACAGAAACAGATCAACGCGATTAGTGAGCGGATTCTTAGCGCTTGTCTGGGACGACCTGCGG
AGCCTGTGCCTTTTCATCTACCACCGATTGAGAGACTTCATATTAATTGCAGCGAGAGCGGGGGAACTTCTGGGACG
CAGCAGTCTCAAGGGACTACGGAGAGGATGGGAAGCCCTTAAGTATCTGGGAAGTCTTGTGCAGTATTGGGGCCTGG
AACTAAAAGGAGTGCTATTAGTCTATTGGATACCCTAGCAATAGCAGTAGGTGAAGGAACAGATAGGATTCTAGAA
TTTGTATTAGGAATTTGTAGAGCTATCCGCAACATACCTACAAGAATAAGACAGGGCTTTGAAACAGCTTTGCTATA
A
>703010505.W7.33
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATACAAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
```

FIG. 17B cont'd

```
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCACTAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W7.30
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTATACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W7.27
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTATACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
```

FIG. 17B cont'd

```
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W7.14
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTGCACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W7.8
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AGGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCGCTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
```

FIG. 17B cont'd

```
GGTGGAGAGAGAAAAAAGAGCAGTGGGAATGGGAGCTGTGTTCCTTGGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W7.15
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTGCACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W7.13
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAATGTCAAAACAATAATAGTACATCTCAATGAATCTGTAAAGATTGAGTG
TATGAGACCCAATAATAAAACAAGAACAAGTATAAGAATAGGACCAGGACAAGCATTTTATGCAACAGGACAAGTAA
TAGGAGACATAAGAGAAGCATATTGTAACATTAATGAAAGTAAATGAATGAAACTTTACAAAGGGTAAGTAAAAAA
TTAAAAGAATACTTCCCTCATAAGAATATAACATTTCAACCATCCTCAGGAGGGGACCTAGAAATTACAACACATAG
CTTTAATTGTGGAGGAGAATTTTTCTATTGCAATACATCAAGCCTGTTTAATAGGACATATATGGCTAATAGTACAG
ATATGGCTAATAGTACAGAAACTAACAGTGCACGAACCATCACAATCCACTGCAGAATAAAACAAATTATAAACATG
TGGCAGGAGGTGGGACGAGCAATGTATGCCCCTCCCATTGCAGGAAACATAACATGTATATCAAATATCACAGGACT
ACTATTGACAAGGGATGGAGGAAAAAACAATACGGAGACATTCAGACCTGGAGGAGGAAATATGAAGGACAATTGGA
GAAGTGAATTATATAAATATAAAGTGGTAGAAGTTAAGCCATTAGGAGTAGCACCCACTAATGCAAGAAGGAGAGTG
GTGGAGAGAGAAAAAAGAGCAGTGGGAATGGGAGCTGTGTTCCTTGGGTTCTTGGGAGCGGCAGGAAGCACTATGGG
CGCAGCATCAATAACGCTGACGGTACAGGCCAGACAATTATTGTCTGGTATAGTGCAACAGCAAAGCAATTTGCTGA
```

FIG. 17B cont'd

```
AGGCTATAGAGGCTCAACAGCATATGTTGAAACTCACGGTCTGGGGCATTAAACAGCTCCAGGCAAGAGTCCTGGCC
TTGGAAAGATACCTAAAGGATCAACAGCTCCTAGGGATGTGGGGCTGCTCTGGAAAACTCATCTGCACCACTAATGT
ATATTGGAACTCTAGTTGGAGTAATAAAACTTATGGTGATATTTGGGATAACATGACCTGGATGCAGTGGGAGAGAG
AAATTAGCAATTATACAGAAATAATATATGAATTGCTTGAAGAATCACAAAACCAGCAGGAAAAGAATGAACAAGAT
TTACTAGCATTGGACAGATGGAACAGTCTGTGGAATTGGTTTAACATAACAAATTGGCTGTGGTATATAAAAATATT
CATAATGATAGTAGGAGGCTTGATAGGTTTAAGAATAATTTTTGCTGTGCTTTCTTTAGTAAATAGAGTTAGGCAGG
GATACTCACCTCTGTCGTTGCAGACCCTTATCCCAAGCCCGAGGGGACCAGACAGGCCCGGAGGAATCGAAGAAGAA
GGTGGAGAGCAAGACAGAAACAGATCAACGCGATTAGTGAGCGGATTCTTAGCGCTTGTCTGGGACGACCTGCGGAG
CCTGTGCCTTTTCATCTACCACCGATTGAGAGACTTCATATTAATTGCAGCGAGAGCGGGGGAACTTCTGGGACGCA
GCAGTCTCAAGGGACTACGGAGAGGATGGGAAGCCCTTAAGTATCTGGGAAGTCTTGTGCAGTATTGGGGCCTGGAA
CTAAAAAGGAGTGCTATTAGTCTATTGGATACCCTAGCAATAGCAGTAGGTGAAGGAACAGATAGGATTCTAGAATT
TGTATTAGGAATTTGTAGAGCTATCCGCAACATACCTACAAGAATAAGACAGGGCTTTGAAACAGCTTTGCTATAA
>703010505.W7.18
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTGCAGAACATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W7.9
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTATACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
```

FIG. 17B cont'd

```
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W7.21
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
CGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W7.3
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACCAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTATACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
```

FIG. 17B cont'd

```
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W7.28
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACCAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGGCTCAACAGCATATGTTGAAACTCACGGTCTGGGGCATTAAACAGCTCCAGGCAAGAGTCCTGGC
CTTGGAAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W7.29
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCGT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAGTAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGGCTCAACAGCATATGTTGAAACTCACGGTCTGGGGCATTAAACAGCTCCAGGCAAGAGTCCTGGC
CTTGGAAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
```

FIG. 17B cont'd

```
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W7.28
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGATCTCTTTTGACCCAATTCCTATACATTATTGTG
CTCCAGCTGGTTATGCGATTCTAAAGTGTAATAATCAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAATACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W7.5
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGATTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
```

FIG. 17B cont'd

```
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W7.20
ATGAGAGTGATGGGGATACAGAGGAATTATCCACAATGGTGGATATGGAGCATGTTAGGCTTTTGGATGCTAATGAT
TGTAATGGGATGTGGGTCACAGTCTACTATGGGGTACCTGTGTGGAAAGAAGCAAAAACTACTCTATTTTGTGCATC
AGATGCTAAAGCATATGAGAAAGAAGTGCATAATGTCTGGGCTACACATGCCTGTGTACCCACAGACCCCAATCCAC
AAGAAATGGTTTTAAAAAATGTAACAGAAAATTTCAACATGTGGAAAAATGACATGGTGGATCAGATGCATGAAGAT
GTAATTAGTTTATGGGATCAAAGCCTCAAGCCATGTGTAAAGTTGACCCCACTCTGTGTCACTCTAAACTGTACCAA
TGCTACTGCCAGCAATAGCAGTATAATAGAGGGAATGAAAAATTGCTCTTTCAATATAACCACAGAATTAAGAGATA
AGAGAGAGAAAAGAATGCACTTTTTTATAAACTTGATATAGTACAACTAGATGGCAACTCTAGTCAGTATAGATTA
ATAAATTGTAATACCTCAGTCATAACACAAGCCTGTCCAAAGGTCTCTTTTGACCCAATTCCTATACATTATTGTGC
TCCAGCTGGTTATGCGATTCTAAAGTGTAATAATAAGACATTCACTGGAACAGGACCGTGTAATAATGTCAGCACAG
TACAATGTACACATGGAATTAAGCCAGTGGTTTCAACTCAACTATTGTTAAATGGTAGCCTAGCAGAAGGAGAGATA
ATAATTAGATCTGAAAATATAACAAACAATGCCAAAACAATAATAGTACATCTCAATGAATCTGTAAAGATTGAGTG
TACGAGACCCAATAATAAAACAAGAACAAGTATAAGAATAGGACCAGGACAAGCATTTTATGCAACAGGACAAGTAA
TAGGAGACATAAGAGAAGCATATTGTAACATTAATGAAAGTAAATGGAATGAAACTTTACAAAGGGTAAGTAAAAAA
TTAAAAGAATACTTCCCTCATAAGAATATAACATTTCAACCATCCTCAGGAGGGGACCTAGAAATTACAACACATAG
CTTTTAATTGTGGAGGAGAATTTTTCTATTGCAATACATCAAGCCTGTTTAATAGGACATATATGGCTAATAGTACAG
ATATGGCTAATAGTACAGAAACTAACAGTACACGAACCATCACAATCCACTGCAGAATAAAACAAATTATAAACATG
TGGCAGGAGGTGGGACGAGCAATGTATGCCCCTCCCATTGCAGGAAACATAACATGTATATCAAATATCACAGGACT
ACTATTGACAAGGGATGGAGGAAAAAACAATACGGAGACATTCAGACCTGGAGGAGGAAATATGAAGGACAATTGGA
GAAGTGAATTATATAAATATAAAGTGGTAGAAGTTAAGCCATTAGGAGTAGCACCCACTAATGCAAGAAGGAGAGTG
GTGGAGAGAGAAAAAAGAGCAGTGGGAATGGGAGCTGTGTTCCTTGGGTTCTTGGGAGCGGCAGGAAGCACTATGGG
CGCAGCATCAATAACGCTGACGGTACAGGCCAGACAATTATTGTCTGGTATAGTGCAACAGCAAAGCAATTTGCTGA
AGGCTATAGAGGCTCAACAGCATATGTTGAAACTCACGGTATGGGGCATTAAACAGCTCCAGGCAAGAGTCCTGGCC
TTGGAAAGATACCTAAAGGATCAACAGCTCCTAGGGATGTGGGCTGCTCTGGAAAACTCATCTGCACCACTAATGT
ATATTGGAACTCTAGTTGGAGTAATAAAACTTATGGTGATATTTGGGATAACATGACCTGGATGCAGTGGGAGAGAG
AAATTAGCAATTATACAGAAATAATATATGAATTGCTTGAAGAATCACAAAACCAGCAGGAAAAGAATGAACAAGAT
TTACTAGCATTGGACAGATGGAACAGTCTGTGGAATTGGTTTAACATAACAAATTGGCTGTGGTATATAAAAATATT
CATAATGATAGTAGGAGGCTTGATAGGTTTAAGAATAATTTTTGCTGTGCTTTCTTTAGTAAATAGAGTTAGGCAGG
GATACTCACCTCTGTCGTTGCAGACCCTTATCCCAAGCCCGAGGGGACCAGACAGGCCCGGAGGAATCGAAGAAGAA
GGTGGAGAGCAAGACAGAAACAGATCAACGCGATTAGTGAGCGGATTCTTAGCGCTTGTCTGGGACGACCTGCGGAG
CCTGTGCCTTTTCATCTACCACCGATTGAGAGACTTCATATTAATTGCAGCGAGAGCGGGGGAACTTCTGGGACGCA
GCAGTCTCAAGGGACTACGGAGAGGATGGGAAGCCCTTAAGTATCTGGGAAGTCTTGTGCAGTATTGGGGCCTGGAA
CTAAAAAGGAGTGCTATTAGTCTATTGGATACCCTAGCAATAGCAGTAGGTGAAGGAACAGATAGGATTCTAGAATT
TGTATTAGGAATTTGTAGAGCTATCCGCAACATACCTACAAGAATAAGACAGGGCTTTGAAACAGCTTTGCTATAA
>703010505.W7.25
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGAATAATAGAGGGAATGAAAAATTGCTCTTTCAATATAACCACAGAATTAAGAGAT
AAGAGAGAGAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCATAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGATGC
AGCAGTCTCAAGGGACTACGGAGAGGATGGGAAGCCCTTAAGTATCTGGGAAGTCTTGTGCAGTATTGGGGCCTGGA
```

FIG. 17B cont'd

ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W7.34
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTATAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAATCATCACAATCCACTGCAGAATAAAACAAATTATAAACAT
GTGGCAGGAGGTGGGACGAGCAATGTATGCCCCTCCCATTGCAGGAAGCATAACATGTATATCAAATATCACAGGAC
TACTATTGACAAGGGATGGAGGAAAAAACAATATGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W7.2
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AGGAGAGCGAAAAAGAATGCACTTTTTTATAAACTTGATATAGTACAACTAGATGGCAACTCTAATCAGTATAGATT
AATAAATTGTAATACCCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATACATGGCTAATAGTACA
GATATGGCAATAGTACAGAAACTAACAGTACACCGCTGCAGAATAAAACAAATTATAAACAT
GTGGCAGGAGGTGGGACGAGCAATGTATGCCCCTCCCATTGCAGGAAACATAACATGTATGTCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA

FIG. 17B cont'd

>703010505.W7.12
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAACTTGATATAGTACAACTAGATGGTAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTATACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W7.32
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAACTTGATATAGTACAACTAGATGGTAACTCTAGTCAGTATAGATT
AATAAATTGTAATACCCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTATACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W7.19

FIG. 17B cont'd

```
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AGGAGAGAGAAAAAGAATGCACTTTTTTATAAACTTGATATAGTACAACTAGATGGCAACTCTAGTCAGTATAGATT
AATAAATTGTAATACCCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
TATATGGCTAATAGTACAGAAACTAACAGTACACGAACCATCACAATCCGCTGCAGAATAAAACAAATTATAAACAT
GTGGCAGGAGGTGGGACGAGCAATGTATGCCCCTCCCATTGCAGGAAAACATAACATGTATATCAAATATCACAGGAC
TACTATTGACAAGGGATGGAGGAAAAAACAATACGGAGACATTCAGACCTGGAGGAGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCGCTCAACAGCATATGTTGAAACGTCACGGTCTGGGGCATTAAGCAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGCAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W7.31
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATATGAAAATATAACAAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCGCTGCAGAATAAAACAAATTATAAACAT
GTGGCAGGAGGTGGGACGAGCAATGTATGCCCCTCCCATTGCAGGAAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCGCTCAACAGCATATGTTGAAACGTCACGGTCTGGGGCATTAAGCAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCCTCTGTCGTTGCAGACCCTTATCCCAAGCCCGAGGGGACCAGACAGGCCCGGAGGAATCGAAGAAGA
AGGTGGAGAGCAAGCAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W7.11
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
```

FIG. 17B cont'd

```
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AGGAGAGAGAAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATACGCTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W7.7
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATACTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTCTTTATAAACTTGATATAGTACAACTAGATGGCAACTCTAGTCAGTATAGATT
AATAAATTGTAATACCCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGTATATTGGAACTC
TAGTTGGAGTAATAAAACTTATGGTGATATTTGGGATAACATGACCTGGATGCAGTGGGAGAGAGAAATTAGCAATT
ATACAGAAATAATATATGAATTGCTTGAAGAATCACAAAACCAGCAGGAAAAGAATGAACAAGATTTACTAGCATTG
GACAGATGGAACAGTCTGTGGAATTGGTTTAACATAACAAATTGGCTGTGGTATATAAAAATATTCATAATGATAGT
AGGAGGCTTGATAGGTTTAAGAATAATTTTTGCTGTGCTTTCTTTAGTAAATAGAGTTAGGCAGGGATACTCACCTC
TGTCGTTGCAGACCCTTATCCCAAGCCCGAGGGGACCAGACAGGCCCGGAGGAATCGAAGAAGAAGGTGGAGAGCAA
GACAGAAACAGATCAACGCGATTAGTGAGCGGATTCTTAGCGCTTGTCTGGGACGACCTGCGGAGCCTGTGCCTTTT
CATCTACCACCGATTGAGAGACTTCATATTAATTGCAGCGAGAGCGGGGAACTTCTGGGACGCAGCAGTCTCAAGG
GACTACGGAGAGGATGGAAGCCCTTAAGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGATAGGATTCTAGAATTTGTATTAGGAAT
TTGTAGAGCTATCCGCAACATACCTACAAGAATAAGACAGGGCTTTGAAACAGCTTTGCTATAA
>703010505.W7.10
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
```

FIG. 17B cont'd

```
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGCCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGTATATTGGAACTC
TAGTTGGAGTAATAAAACTTATGGTGATATTTGGGATAACATGACCTGGATGCAGTGGGAGAGAGAAATTAGCAATT
ATACAGAAATAATATATGAATTGCTTGAAGAATCACAAAACCAGCAGGAAAAGAATGAACAAGATTTACTAGCATTG
GACAGATGGAACAGTCTGTGGAATTGGTTTAACATAACAAATTGGCTGTGGTATATAAAAATATTCATAATGATAGT
AGGAGGCTTGATAGGTTTAAGAATAATTTTTGCTGTGCTTTCTTTAGTAAATAGAGTTAGGCAGGGATACTCACCTC
TGTCGTTGCAGACCCTTATCCCAAGCCCGAGGGGACCGAGGCCCGGGAGGAATCGAAGAAGAAGGTGGAGAGCAA
GACAGAAACAGATCAACGCGATTAGTGAGCGGATTCTTAGCGCTTGTCTGGGACGACCTGCGGAGCCTGTGCCTTTT
CATCTACCACCGATTGAGAGACTTCATATTAATTGCAGCGAGAGCGGGGAACTTCTGGGACGCAGCAGTCTCAAGG
GACTACGGAGAGGATGGGAAGCCCTTAAGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGATAGGATTCTAGAATTTGTATTAGGAAT
TTGTAGAGCTATCCGCAACATACCTACAAGAATAAGACAGGGCTTTGAAACAGCTTTGCTATAA
>703010585.W7.4
ATGAGAGTGATGGGGATACAGAGGAATTATCCACAATGGTGGATATGGAGCATGTTAGGCTTTTGGATGCTAATGAT
TTGTAATGGGATGTGGGTCACAGTYTACTATGGGGTACCTGTGTGGAAAGAAGCAAAAAMTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTATACGAACCATCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGAGGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010585.W7.23
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAMAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
```

FIG. 17B cont'd

```
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTAYACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010503.W7.1
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W8.2
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACACTCCACTGCAGAATAAAACAAATTATAAACAT
```

FIG. 17B cont'd

```
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>793010505.W8.20
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAGGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCCGAAAATATAACAAACAATGCCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACACTCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAACTATCCGCAACATACCTACAAGAATAAGACAGGGCTTTGAAACAGCTTTGCTATAA
>793010505.W8.22
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
CGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCTACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCTACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
```

FIG. 17B cont'd

```
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAACAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGCGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W8.26
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAATACTAGATGGCAACTCTAGTCAGTATAGATT
AATAAATTGTAATACCCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACAGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAACAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGCGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W8.12
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAATACTAGATGGCAACTCTAGTCAGTATAGATT
AATAAATTGTAATACCCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACAGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
```

FIG. 17B cont'd

```
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W8.5
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCAGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAACCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W8.8
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGAATAATAGAGGGAATGAAAAATTGCTCTTTCAATATAACCACAGAATTAAGAGAT
AAGAGAGAGAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
```

FIG. 17B cont'd

```
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W8.13
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTGCACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W8.19
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACAGCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACCAGCAATGTATGCCCCTCCCATTGCAGGAAACATAACATGTATATCAAATATCACAGGAC
TACTATTGACAAGGGATGGAGGAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
```

FIG. 17B cont'd

```
GAAATTAGCAATTATACAGAAATAATATATGAATTGCTTGAAGAATCACAAAACCAGCAGGAAAAGAATGAACAAGA
TTTACTAGCATTGGACAGATGGAACAGCCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGAACAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W8.11
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTATACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W8.16
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTATACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAACAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
```

FIG. 17B cont'd

```
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W8.7
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAATCAATTGCTG
AAGGCTATAGAGGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAAGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W8.27
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
```

FIG. 17B cont'd

```
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W8.15
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGATTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCCTTATCCCAAGCCCGAGGGGACCAGACAGGCCCGGAAGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W8.6
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
```

FIG. 17B cont'd

```
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.N8.18
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTATACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.N8.9
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTATACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
```

FIG. 17B cont'd

```
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACCTACCTACAAGAATAAGACAGGGCTTTGAAACAGCTTTGCTATAA
>703010505.W8.3
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTATACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W8.17
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTAAACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
```

FIG. 17B cont'd

>703010505.W8.25
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAACTACTCTATTTTGTGCATC
AGATGCTAAAGCATATGAGAAAGAAGTGCATAATGTCTGGGCTACACATGCCTGTGTACCCACAGACCCCAATCCAC
AAGAAATGGTTTTAAAAAATGTAACAGAAAATTTCAACATGTGGAAAAATGACATGGTGGATCAGATGCATGAAGAT
GTAATTAGTTTATGGGATCAAAGCCTCAAGCCATGTGTAAAGTTGACCCCACTCTGTGTCACTCTAAACTGTACCAA
TGCTACTGCCCAGCAATAGCAGTATAATAGAGGGAATGAAAAATTGCTCTTTCAATATAACCACAGAATTAAGAGATA
AGAGAGAGAAAAAGAATGCGCTTTTTTTATAAACTTGATATAGTACAACTAGATGGCAACTCTAGTCAGTATAGATTA
ATAAATTGTAATACCCTCAGTCATAACACAAGCCTGTCCAAAGGTCTCTTTTGACCCAATTCCTATACATTATTGTGC
TCCAGCTGGTTATGCGATTCTAAAGTGTAATAATAAGACATTCACTGGAACAGGACCGTGTAATAATGTCAGCACAG
TACAATGTACACATGGAATTAAGCCAGTGGTTTCAACTCAACTATTGTTAAATGGTAGCCTAGCAGAAGGAGAGATA
ATAATTAGATCTGAAAATATAACAAACAATGTCAAAACAATAATAGTACATCTCAATGAATCTGTAAAGATTGAGTG
TACGAGACCCAATAATAAAACAAGAACAAGTATAAGAACAGGACAAGCATTTTATGCAACAGGACAAGTAA
TAGGGAGACATAAGAGAAGCATATTGTAACATTAATGAAAGTAAATGGAATGAAACTTTACAAAGGGTAAGTAAAAAA
TTAAAAGAATACTTCCCTCATAAGAATATAACATTTCAACCATCCTCAGGAGGGGACCTAGAAATTACAACACATAG
CTTTAATTGTGGAGGAGAATTTTTCTATTGCAATACATCAAGCCTGTTTAATAGTACAGATATGGCTAATAGTACAG
AAACTAACAGTACACGAATCATCACAATCCACTGCAGAATAAAACAAATTATAAACATGTGGCAGGAGGTGGGACGA
GCAATGTATGCCCCTCCCATTGCAGGAAACATAACATGTATATCAAATATCACAGGACTACTATTGACAAGGGATGG
AGGAAAAAACAATACGGAGACATTCAGACCTGGAGGAGGAAATATGAAGGACAATTGGAGAAGTGAATTATATAAAT
ATAAAGTGGTAGAAGTTAAGCCATTAGGAGTAGCACCCACTAATGCAAGAAGGAGAGTGGTGGAGAGAGAAAAAAGA
GCAGTGGGAATGGGAGCTGTGTTCCTTGGGTTCTTGGGAGCGGCAGGAAGCACTATGGGCGCAGCATCAATAACGCT
GACGGGTACAGGCCAGACAATTATTGTCTGGTATAGTGCAACAGCAAAGCAATTTGCTGAAGGCTATAGAGGCTCAAC
AGCATATGTTGAAACTCACGGTCTGGGGCATTAAACAGCTCCAGGCAAGAGTCCTGGCCTTGGAAAGATACCCTAAAG
GATCAACAGCTCCTAGGGATGTGGGGCTGCTCTGGAAAACTCATCTGCACCACTAATGTATATTGGAACTCTAGTTG
GAGTAATAAAACTTATGGTGATATTTGGGATAACATGACCTGGATGCAGTGGGAGAGAGAAATTAGCAATTATACAG
AAATAATATATGAATTGCTTGAAGAATCACAAAACCAGCAGGAAAAGAATGAACAAGATTTACTAGCATTGGACAGA
TGGAACAGTCTGTGGAATTGGTTTAACATAACAAATTGGCTGTGGTATATAAAAATATTCATAATGATAGTAGGAGG
CTTGATAGGTTTAAGAATAATTTTTGCTGTGCTTTCTTTAGTAAATAGAGTTAGGCAGGGATACTCACCTCTGTCGT
TGCAGACCCTTATCCCAAGCCCGAGGGGACCAGACAGGCCCGGAGGAATCGAAGAAGAAGGTGGAGAGCAAGACAGA
AACAGATCAACGCGATTAGTGAGCGGATTCTTAGCGCTTGCTCTGGGACGACCTGCGGAGCCTGTGCCTTTTCATCTA
CCACCGATTGAGAGACTTCATATTAATTGCAGCGAGAGCGGGGGAACTTCTGGGACGCAGCAGTCTCAAGGGACTAC
GGAGAGGATGGGAAGCCCTTAAGTATCTGGGAAGTCTTGTGCAGTATTGGGGCCTGGAACTAAAAAGGAGTGCTATT
AGTCTATTGGATACCCTAGCAATAGCAGTAGGTGAAGGAACAGATAGGATTCTAGAATTTGTATTAGGAATTTGTAG
AGCTATCCGCAACATACCTACAAGAATAAGACAGGGCTTTGAAACAGCTTTGCTATAA
>703010505.W8.28
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCGCACTTTTTTATAAACTTGATATAGTACAACTAGATGGCAACTCTAGTCAGTATAGATT
AATAAATTGTAATACCCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTATACGAACCATCACAATCCACTGCAGAATAAAACAAATTATAAACAT
GTGGCAGGAGGTGGGACGAGCAATGTATGTCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCCTAAAGGATCAACAGCTCCTAGGGATGTGGGGCTGCTCTGGAAAACTCATCTGCACCACTAATG
TATATTAGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGTCTGTGTGGAATTGGTTTAACATAACAAATTGGCTGTGGTATATAAAATATTCATAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W8.14

FIG. 17B cont'd

ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AGGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACARGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCGCTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W8.1
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTATACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTYAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGRATTCTAGAAT
TTGTATTAGGAATTTGTAGAGCTATCCGCAACATACCTACAAGAATAAGACAGGGCTTTGAAACAGCTTTGCTATAA
>703010505.W9.33
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTGAGCATGTTAG

FIG. 17B cont'd

```
GCTTTTGGATGCTAATGATTTGTAATGGGATGTGGGTCACAGTCTACTATGGGGTACCTGTGTGGAAAGAAGCAAAA
ACTACTCTATTTTGTGCATCAGATGCTAAAGCATATGAGAAAGAAGTGCATAATGTCTGGGCTACACATGCCTGTGT
ACCCACAGACCCCAATCCACAAGAAATGGTTTTAAAAAATGTAACAGAAAATTTCAACATGTGGAAAAATGACATGG
TGGATCAGATGCATGAAGACGTAATTAGTTTATGGGATCAAAGCCTCAAGCCATGTGTAAAGTTGACCCCACTCTGT
GTCACTCTAAACTGTACCAATGCTACTGCCAGCAGTAGCAGTATAATAGAGGGAATGAAAAATTGCTCTTTCAATAT
AACCACAGAATTAAGAGATAAGAGAGAGAAAAAGAATGCACTTTTTTATAAACTTGATATAGTACAACTAGATGGCA
ACTCTAGTCAGTATAGAATTAATAAATTGTAATACCTCAGTCATAACACAAGCCTGTCCAAAGGTCTCTTTTGACCCA
ATTCCTATACATTATTGTGCTCCAGCTGGTTATGCGATTCTAAAGTGTAATAATAAGACATTCACTGGAACAGGACC
GTGTAATAATGTCAGCACAGTACAATGTACACATGGAATTAAGCCAGTGGTTTCAACTCAACTATTGTTAAATGGTA
GCCTAGCAGAAGGAGAGATAATAATTAGATCTGAAAATATAACAAACAATGTCAAAACAATAATAGTACATCTCAAT
GAATCTGTAAAGATTGAGTGTACGAGACCCAATAATAAAACAAGAACAAGTATAAGAATAGGACCAGGACAAGCATT
TTATGCAACAGGACAAGTAATAGGAGACATAAGAGAAGCATATTGTAACATTAATGAAAGTAAATGGAATGAAACTT
TACAAAGGGTAAGTAAAAAATTAAAAGAATACTTCCCTCATAAGAATATAACATTTCAACCATCCCCAGGAGGGGAC
CTAGAAATTACAACACATAGCTTTAATTGTGGAGGAGAATTTTTCTATTGCAATACATCAAGCCTGTTTAATAGGAC
ATATATGGCTAATAGTACAGATATGGCTAATAGTACAGAAACTAACAATACACGAACCATCACAATCCACTGCAGAA
TAAAACAAATTATAAACATGTGGCAGGAGGTGGGACGAGCAATGTATGCCCCTCCCATTGCAGGAAACATAACATGT
ATATCAAATATCACAGGACTACTATTGACAAGGGATGGAGGAAAAAACAATACGGAGACATTCAGACCTGGAGGAGG
AAATATGAAGGACAATTGGAGAAGTGAATTATATAAATATAAAGTGGTAGAAGTTAAGCCATTAGGAGTAGCACCCA
CTAATGCAAGAAGGAGAGTGGTGGAGAGAGAAAAAAGAGCAGTGGGAATGGGAGCTGTGTTCCTTGGGTTCTTGGGA
GCGGCAGGAAGCACTATGGGCGCAGCATCAATAACGCTGACGGTACAGGCCAGACAATTATTGTCTGGTATAGTGCA
ACAGCAAAGCAATTTGCTGAAGGCTATAGAGGCTCAACAGCATATGTTGAAACTCACGGTCTGGGGCATTAAACAGC
TCCAGGCAAGAGTCCTGGCCTTGGAAAGATACCTAAAGGATCAACAGCTCCTAGGGATGTGGGGCTGCTCTGGAAAA
CTCATCTGCACCACTAATGTATATTGGAACTCTAGTTGGAGTAATAAAACTTATGGTGATATTTGGGATAACATGAC
CTGGATGCAGTGGGAGAGAGAAATTAGCAATTATACAGAAATAATATATGAATTGCTTGAAGAATCACAAAACCAGC
AGGAAAAGAACGAACAAGATTTACTAGCATTGGACAGATGGAACAGTCTGTGGAATTGGTTTAACATAACAAATTGG
CTGTGGTATATAAAAATATTCATAATGATAGTAGGAGGCTTGATAGGTTTAAGAATAATTTTTGCTGTGCTTTCTTT
AGTAAATAGAGTTAGGCAGGGATACTCACCTCTGTCGTTGCAGACCCTTATCCCAAGCCCGAGGGGACCAGACAGGC
CCGGAGGAATCGAAGAAGAAGGTGGAGAGCAAGACAGAAACAGATCAACGCGATTAGTGAGCGGATTCTTAGCGCTT
GTCTGGGACGACCTGCGGAGCCTGTGCCTTTTCATCTACCACCGATTGAGAGACTTCATATTAATTGCAGCGAGAGC
GGGGGAACTTCTGGGACGCAGCAGTCTCAAGGGACTACGGAGAGGATGGGAAGCCCTTAAGTATCTGGGAAGTCTTG
TGCAGTATTGGGGCCTGGAACTAAAAAGGAGTGCTATTAGTCTATTGGATACCCTAGCAATAGCAGTAGGTGAAGGA
ACAGATAGGATTCTAGAATTTGTATTAGGAATTTGTAGAGCTATCCGCAACATACCTACAAGAATAAGACAGGGCTT
TGAAACAGCTTTGCTATAA
>703010505.W9.27
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTATACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAACGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W9.19
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
```

FIG. 17B cont'd

```
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
CGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGGCAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCCAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W9.4
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATATGAAAATATAACAAACAATGTCAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCCTAATAGTACA
GATATGGCTAATAGTACAGAAACTAACAATACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAGGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATAATAGTAGGAGGCTTGATAGGTTTAAGAATAATTTTTGCTGTGCTTTCTTTAGTAAATAAAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W9.2
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
```

FIG. 17B cont'd

```
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGGCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAATCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATATGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGGCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W9.23
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGGCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAATCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W9.7
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTTACTCTAAACTGTACCA
ATGCTACTGCCAGCAATAGCAGTATAATAGAGGGAATGAAAAATTGCTCTTTCAATATAACCACAGAATTAAGAGAT
```

FIG. 17B cont'd

```
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACAAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAAGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W9.1
ATGAGAGTGATGGGGATACAGAGGAATTATCCACAATGGTGGATATGGAGCATGTTAGGCTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATATGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAATACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTKG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W9.30
ATGAGAGTGATGGGGATACAGAGGAATTATCCACAATGGTGGATATGGAGCATGTTAGGCTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
```

FIG. 17B cont'd

```
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATATGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W9.5
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTATACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W9.12
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
```

FIG. 17B cont'd

```
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTATACGAACCATCACAATCCACTGCAGAATAAAACAAATTATAAACAT
GTGGCAGGAGGTGGGACGAGCAATGTATGCCCCTCCCATTGCAGGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAACGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W9.14
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGCGGAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGGAATGAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTATACGAACCATCACAATCCACTGCAGAATAAAACAAATTATAAACAT
GTGGCAGGAGGTGGGACGAGCAATGTATGCCCCTCCCATTGCAGGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTAGGAGCGGCAGGAAGCACTATGG
GCGCAGCATCAATAACGCTGACGGTACAGGCCAGACAATTATTGTCCGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAACGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W9.9
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGCGGAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGGAATGAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGATTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
```

FIG. 17B cont'd

```
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTAACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGACACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W9.24
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTTGACCCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TAATATTGCAAGGGATGGAGGAAAAAACAATACGGACACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W9.13
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
```

FIG. 17B cont'd

```
GCTTTAATTGTGGAGGAGAATTTTTCTATTGCAATACATCAAGCCTGTTTAATAGGACATATATGGCTAATAGTACA
GATATGGCTAATAGTACAGAAACTAACAATACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTATTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W9.18
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
CGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAAACTTGATATAGTACAACTAGATGGCAACTCTAGTCAGTATAGATT
AATAAATTGTAATACCCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGTGGCTAATAGTACA
GATATGGCTAATAGTACAGAAACTAACAGTACACGAATCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W9.25
ATGGGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAAACTTGATATAGTACAACTAGATGGCAACTCTAGTCAGTATAGATT
AATAAATTGTAATACCCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAATCATCACAATCCACTGCAGAATAAAACAAATTATAAACAT
```

FIG. 17B cont'd

```
GTGGCAGGAGGTGGGACGAGCAATGTATGCCCCTCCCATTGCAGGGAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGTGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W9.3
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTTAAAACAATAATAGTACATCTCAATGAATCTGTAAAGATTGAGT
GTACGAGACCCAATAATAAAACAAGAACAAGTATAAGATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTATACGAACCATCACAATCCACTGCAGAATAAAACAAATTATAAACAT
GTGGCAGGAGGTGGGACGAGCAATGTATGCCCCTCCCATTGCAGGGAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGTTATAA
>703010505.W9.32
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
CGTAATTAGTTTATGGGATCAAAGCCTCAAGCCATGTGTAAAGTTGACCCCACTCTGTGTCACTCTAAACTGTACCA
ATGCTACTGCCAGCAGTCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGCAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACAGAATCATCACCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
```

FIG. 17B cont'd

```
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W9.22
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTTATAAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACAGAACCATCACAATCCGCTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCACTAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W9.21
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATGAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACAGAACCATCACAATCCGCTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
```

FIG. 17B cont'd

```
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W9.31
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTATACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W9.20
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTCGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTATACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
```

FIG. 17B cont'd

CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W9.16
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCACTATTATGACAAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GAAACTAACAATACACGAACCATCACAATCCACTGCAGAATAAAACAAATTATAAACATGTGGCAGGAGGTGGGACG
AGCAATGTATGCCCCTCCCATTGCAGGAAACATAACATGTATATCAAATATCAACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGTATATTGGAACTCTAGTTGGAGTAATAAAAC
TTATGGTGATATTTGGGATAACATGACCTGGATGCAGTGGGAGAGAAAATTAGCAATTATACAGAAATAATATATG
AATTGCTTGAAGAATCACAAAACCAGCAGGAAAAGAATGAACAAGATTTACTAGCATTGGACAGATGGAACAGTCTG
TGGAATTGGTTTAACATAACAAATTGGCTGTGGTATATAAAAATATTCATAATGATAGTAGGAGGCTTGATAGGTTT
AAGAATAATTTTTGCTGTGCTTTCTTTAGTAAATAGAGTTAGGCAGGGATACTCACCTCTGTCGTTGCAGACCCTTA
TCCCAAGCCCGAGGGGACCAGACAGGCCCGGAGGAATCGAAGAAGGTGGAGAGCAAGACAAGACAGAAACAGATCAACG
CGATTAGTGAGCGGATTCTTAGCGCTTGTCTGGGACGACCTGCGGAGCCTGTGCCTTTTCATCTACCACCGATTGAG
AGACTTCATATTAATTGCAGCGAGAGCGGGGGAACTTCTGGGACGCAGCAGTCTCAAGGGACTACGGAGAGGATGGG
AAGCCCTTAAGTATCTGGGAAGTCTTGTGCAGTATTGGGGCCTGGAACTAAAAAGGAGTGCTATTAGTCTATTGGAT
ACCCTAGCAATAGCAGTAGGTGAAGGAACAGATAGGATTCTAGAATTTGTATTAGGAATTTGTAGAGCTATCCGCAA
CATACCTACAAGAATAAGACAGGGCTTTGAAACAGCTTTGCTATAA
>703010505.W9.11
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
CGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTRYACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA

FIG. 17B cont'd

AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W9.28
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTRYACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W10.8
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
CGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACGAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTGCACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC

FIG. 17B cont'd

AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTAGTAGGAATTTGTAGAGCTATCCGCAACATACCTACAAGAATAAGACAGGGCTTTGAAACAGCTTTGCTATAA
>703010505.W10.9
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
CGTAATTAGTTTATGGGATCAAAGCCTCAAGCCATGTGTAAAGTTGACCCCACTCTGTGTCACTCTAAACTGTACCA
ATGCTACTACCAGCAATAGCAGTATAATAGAGGGAATGAAAAATTGCTCTTTCAATATAACCACAGAATTAAGAGAT
AAGAGAGAGAAAAGAATGCACTTTTTTATAAACTTGATATAGTACAACTAGATGGCAACTCTAGTCACAAACCATC
ACAATCCACTGCAGAATAAAACAAATTATAAACATGTGGCAGGAGGTGGGACGAGCAATGTATGCCCCTCCCATTGC
AGGAAACATAACATGTATATCAAATATCACAGGACTACTATTGACAAGGGATGGAGGAAAAAACAATACGGAGACAT
TCAGACCTGGAGGAGGAAATATGAAGGACAATTGGAGAAGTGAATTATATAAATATAAAGTGGTAGAAGTTAAGCCA
TTAGGAGTAGCACCCACTAATGCAAGAAGGAGAGTGGTGGAGAGAGAAAAAAGAGCAGTGGGAATGGGAGCTGTGTT
CCTTGGGTTCTTGGGAGCGGCAGGAAGCACTATGGGCGCAGCATCAATAACGCTGACGGTACAGGCCAGACAATTAT
TGTCTGGTATAGTGCAACAGCAAAGCAATTTGCTGAAGGCTATAGAGGCTCAACAGCATATGTTGAAACTCACGGTC
TGGGGCATTAAACAGCTCCAGGCAAGAGTCCTGGCCTTGGAAAGATACCTAAAGGATCAACAGCTCCTAGGGATGTG
GGGCTGCTCTGGAAAACTCATCTGCACCACTAATGTATATTGGAACTCTAGTTGGAGTAATAAAACTTATGGTGATA
TTTGGGATAACATGACCTGGATGCAGTGGGAGAGAGAAATTAGCAATTATACAGAAATAATATATGAATTGCTTGAA
GAATCACAAAACCAGCAGGAAAAGAATGAACAAGATTTACTAGCATTGGACAGATGGAACAGTCTGTGGAATTGGTT
TAACATAACAAATTGGCTGTGGTATATAAAAATATTCATAATGATAGTAGGAGGCTTGATAGGTTTAAGAATAATTT
TTGCTGTGCTTTCTTTAGTAAATAGAGTTAGGCAGGGATACTCACCTCTGTCGTTGCAGACCCTTATCCCAAGCCCG
AGGGGACCAGACAGGCCCGGAGGAATCGAAGAAGAAGGTGGAGAGCAAGACAGAAACAGATCAACGCGATTAGTGAG
CGGATTCTTAGCGCTTGTCTGGGACGACCTGCGGAGCCTGTGCCTTTTCATCTACCACCGATTGAGAGACTTCATAT
TAATTGCAGCGAGAGCGGGGGAACTTCTGGGACGCAGCAGTCTCAAGGGACTACGGAGAGGATGGGAAGCCCTTAAG
TATCTGGGAAGTCTTGTGCAGTATTGGGGCCTGGAACTAAAAAGGAGTGCTATTAGTCTATTGGATACCCTAGCAAT
AGCAGTAGGTGAAGGAACAGATAGGATTCTAGAATTTGTATTAGGAATTTGTAGAGCTATCCGCAACATACCTACAA
GAATAAGACAGGGCTTTGAAACAGCTTTGCTATAA
>703010505.W19.1
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AGGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATGAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAGGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGCTAATAGTACAGAAACTAACAGTACACGAACCATCACAATCCGCTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGTCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W19.28
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT

FIG. 17B cont'd

```
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAATACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W10.2
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAATACACGAACCATCACAATCCACTGCAGAATAAGACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGGATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W10.12
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
```

FIG. 17B cont'd

CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCAACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCACTAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010895.W10.32
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATCAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCAACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010895.W10.31
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT

FIG. 17B cont'd

AATAATTAGATCTGAAAATATAACAAACAATGGCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAATCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCGTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTGCTATAA
>703010505.W10.6
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTGCACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTGCTATAA
>703010505.W10.15
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA

FIG. 17B cont'd

```
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTAAACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCAGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGCTTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W10.18
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGCTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACAGAATCATCACCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGGAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W10.21
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
```

FIG. 17B cont'd

```
GCTTTAATTGTGGAGGAGAATTTTTCTATTGCAATACATCAAGCCTGTTTAATAGGACATATATGGCTAATAGTACA
GATATGGCTAATAGTACAGAAACTAACAATACACGAACCATCACAATCCACTGCAGAATAAAACAAATTATAAACAT
GTGGCAGGAGGTGGGACGAGCAATGTATGCCCCTCCCATTGCAGGAAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W10.27
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
CGTAATTAGTTTATAGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGCCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCAGAATAAAACAAATTATAAACAT
GTGGCAGGAGGTGGGACGAGCAATGTATGCCCCTCCCATTGCAGGAAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W10.26
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATACTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAAGGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCGCTGCAGAATAAAACAAATTATAAACAT
```

FIG. 17B cont'd

```
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>?03010505.W10.24
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGGCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACATCAACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>?03010505.W10.7
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACATCAACTGCAGAATAAAACAAATTATAAACAT
GTGGCAGGAGGTGGGACGAGCAATGTATGCCCCTCCCATTGCAGGAAACATAACATGTATATCAAATATCACAGGAC
TAATATTGACAAGGGATGGAGGAAAAAACAATACGGAGACATTCAGACCTGGAGGAGGAAATATGAAGGACAATTGG
```

FIG. 17B cont'd

AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W10.16
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
CGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGATCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCGCTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGAAAGTCTTGTGCAGTATTGGGCCTAGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W10.20
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AGGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAAAAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCGCTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG

FIG. 17B cont'd

```
GCGCAGCATCAATAACGCTGACGGTACAGGCCAGACAATTATTGTCTGGTATAGTGCAACAGCAAAGCAACTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W10.13
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGCTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAATCCACTGCGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAGAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W10.22
ATGAGAGTGATGGGGATACAGAGGAATTATCCACAATGGTGGATATGGAGCATGTTAGGCTTTTGGATGCTGATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGGCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCACTGCGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
```

FIG. 17B cont'd

```
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGTAATTATACAGAAATAATATATGAATTGCTTGAAGAATCACAAAACCAGCAGGAAAAGAATGAACAAGA
TTTACTAGCATTGGACAGATGGAACAGGCTGTGGAATTGGTTTAACATAACAAATTGGCTATGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W10.25
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCATTATTGTTAAATGGTAGCCTAGCAGAAGGAGAGAT
AATAATTAGATCTGAAAATATAACAAACAATGGCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAATCATCACCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTGGCATTGGACAGATGGAACAGGCTGTGGAATGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W14.29
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
CGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAGAATGCACTTTTTTTATAAACTTGATATAGTACAGCTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACGAACAGTACACGAACCATCAAAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGAATGGGAGCTGTGTTCCTTGGGTTCTTGGGAGCGGCAGGAAGCACTATGG
GCGCAGCATCAGTAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
```

FIG. 17B cont'd

```
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAATAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W14.3
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
CGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGTGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCAAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAAAAT
TTGTATTAGGAATTTGTAGAGCTATCCGAAACATACCTACAAGAATAAGACAGGGCTTTGAAACAGCTTTGCTATAA
>703010505.W14.33
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
CGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTATTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCAAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAAAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
```

FIG. 17B cont'd

```
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAAAAT
TTGTATTAGGAATTTGTAGAGCTATCCGCAACATACCTACAAGAATAAGACAGGGCTTTGAAACAGCTTTGCTATAA
>703010505.W14.32
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
CGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTATTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCAAAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAAAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAAAAT
TTGTATTAGGAATTTGTAGAGCTATCCGCAACATACCTACAAGAATAAGACAGGGCTTTGAAACAGCTTTGCTATAA
>703010505.W14.22
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCAAAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
AAATTAGCAATTATACAGAAATAATATATGAATTGCTTGAAGAATCACAAAACCAGCAGGAAAAGAATGAACAAGAT
TTACTAGCATTGGACAGATGGAACAGTCTGTGGAATTGGTTTAACATAACAAATTGGCTGTGGTATATAAAAATATT
CATAATGATAGTAGGAGGCTTGATAGGTTTAAGAATAATTTTTGCTGTGCTTTCTTTAGTAAATAGAGTTAGGCAGG
GATACTCACCTCTGTCGTTGCAGACCCTTATCCCAAGCCCGAGGGGACCAGACAGGCCCGGAGGAATCGAAGAAGAA
```

FIG. 17B cont'd

```
GGTGGAGAGCAAGACAGAAACAGATCAACGCGATTAGTGAGCGGATTCTTAGCGCTTGTCTGGGACGACCTGCGGAG
CCTGTGCCTTTTCATCTACCACCGATTGAGAGACTTCATATTAATTGCAGCGAGAGCGGGGGAACTTCTGGGACGCA
GCAGTCTCAAGGGACTACGGAGAGGATGGGAAGCCCTTAAGTATCTGGGAAGTCTTGTGCAGTATTGGGGCCTGGAA
CTAAAAAGGAGTGCTATTAGTCTATTGGATACCCTAGCAATAGCAGTAGGTGAAGGAACAGATAGGATTCTAAAATT
TGTATTAGGAATTTGTAGAGCTATCCGCAACATACCTACAAGAATAAGACAGGGCTTTGAAACAGCTTTGCTATAA
>703010505.W14.34
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACAGAATCATCAAAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAAAAT
TTGTATTAGGAATTTGTAGAGCTATCCGCAACATACCTACAAGAATAAGACAGGGCTTTGAAACAGCTTTGCTATAA
>703010505.W14.16
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCAAAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
```

FIG. 17B cont'd

```
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.N14.31
ATGAGAGTGATGGGGATACGAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAAAAAGAATGCACTTTTTTTATAAACTTGATATAGTACAACTAGATGGCAACTCTAGTCAGTATAGATT
AATAAATTGTAATACCCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCAAAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.N14.4
ATGAGAGTGATGGGGATACGAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAAAAAGAATGCACTTTTTTTATAAACTTGATATAGTACAACTAGATGGCAACTCTAGTCAGTATAGATT
AATAAATTGTAATACCCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCAAAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAAGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
```

FIG. 17B cont'd

```
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W14.6
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCAAAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGCAAGGGATGGAGGAAAAAACAATACGGAGACATTCAGACCTGGAGGAGGAAATATGAAGGATAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGACGGATTCTTAGCGCTTGTCTGGGACGACCTGCCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W14.20
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACTCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCAAAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAAAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGACGGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
```

FIG. 17B cont'd

>703010505.W14.39
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCAAAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGAGACTACGGAGAGGATGGGAAGCCCTTAAGTATCTGGGAAATCTTGTGCAGTATTGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W14.30
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCGTCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W14.19

FIG. 17B cont'd

ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATACTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCCAATAATAAAACAAGAACAAGTATAAGATAGGACCAGGACAAGCATTTTATGCAACAGGACAAGT
AATAGGAGACATAAGAGAAGCATATTGTAACATTAATGAAAGTAAATGGAATGAAACTTTACAAAGGGTAAGTAAAA
AATTAAAAGAATACTTCCCTCATAAGAATATAACATTTCAACCATCCTCAGGAGGGGACCTAGAAATTACAACACAT
AGCTTTAATTGTGGAGGAGAATTTTTCTATTGCAATACATCAAGCCTGTTTAATAGGACATATATGGCTAATAGTAC
AGATATGGCTAATAGTACAGAAACTAACAGTACACGAACCATCACAATCCGCTGCAGAATAAAACAAATTATAAACA
TGTGGCAGGAGGTGGGACGAGCAATGTATGCCCCTCCCATTGCAGGAAACATAACATGTATATCAAATATCACAGGA
CTACTATTGACAAGGGATGGAGGAAAAAACAATACGGAGACATTCAGACCTGGAGGAGGAAATATGAAGGACAATTG
GAGAAGTGAATTATATAAATATAAAGTGGTAGAAGTTAAGCCATTAGGAGTAGCACCCACTAATGCAAGAAGGAGAG
TGGTGGAGAGAGAAAAAAGAGCAGTGGGAATGGGAGCTGTGTTCCTTGGGTTCTTGGGAGCGGCAGGAAGCACTATG
GGCGCAGCATCAATAACGCTGACGGTACAGGCCAGACAATTATTGTCTGGTATAGTGCAACAGCAAAGCAATTTGCT
GAAGGCTATAGAGGCTCAACAGCATATGTTGAAACTCACGGTCTGGGGCATTAAACAGCTCCAGGCAAGAGTCCTGG
CCTTGGAAAGATACCTAAAGGATCAACAGCTCCTAGGGATGTGGGGCTGCTCTGGAAAACTCATCTGCACCACTAAT
GTATATTGGAACTCTAGTTGGAGTAATAAAACTTATGGTGATATTTGGGATAACATGACCTGGATGCAGTGGGAGAG
AGAAATTAGCAATTATACAGAAATAATATATGAATTGCTTGAAGAATCACAAAACCAGCAGGAAAAGAATGAACAAG
ATTTACTAGCATTGGACAGATGGAACAGTCTGTGGAATTGGTTTAACATAACAAATTGGCTGTGGTATATAAAAATA
TTCATAATGATAGTAGGAGGCTTGATAGGTTTAAGAATAATTTTTGCTGTGCTTTCTTTAGTAAATAGAGTTAGGCA
GGGATACTCACCTCTGTCGTTGCAGACCCTTATCCCAAGCCCGAGGGGACCAGACAGGCCCGGAGGAATCGAAGAAG
AAGGTGGAGAGCAAGACAGAAACAGATCAACGCGATTAGTGAGCGGATTCTTAGCGCTTGTCTGGGACGACCTGCGG
AGCCTGTGCCTTTTCATCTACCACCGATTGAGAGACTTCATATTAATTGCAGCGAGCGAGAGCGGGGGAACTTCTGGGACG
CAGCAGTCTCAAGGGACTACGGAGAGGATGGGAAGCCCTTAAGTATCTGGGAAGTCTTGTGCAGTATTGGGGCCTGG
AACTAAAAAGGAGTGCTATTAGTCTATTGGATACCCTAGCAATAGCAGTAGGTGAAGGAACAGATAGGATTCTAGAA
TTTGTATTAGGAATTTGTAGAGCTATCCGCAACATACCTACAAGAATAAGACAGGGCTTTGAAACAGCTTTGCTATA
A
>703010505.W14.2
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAAACTTGATATAGTACAACTAGATGGCAACTCTAGTCAGTATAGATT
AATAAATTGTATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCGCTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCGTTAGTAAATAGGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W14.17

FIG. 17B cont'd

ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCYAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCRTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAAAAT
TTGTATTAAGAATTTGTAGAGCTATCCGCAACATACCTACAAGAATAAGACAGGGCTTTGAAACAGCTTTGCTATAA
>703010505.W14.21
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAATCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAAAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
CGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W14.11
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT

FIG. 17B cont'd

CAGATGCTAAAGCATATGAGAAAGAAGTGCATAATGTCTGGGCTACACATGCCTGTGTACCCACAGACCCCAATCCA
CAAGAGATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTATCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGGCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAATCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATCGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W14.10
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAGATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTATCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGGCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAATCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATCGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W14.15
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAGATGGTTTTAAAAAATGTAACAGAAAATTTCAACATGTGGAAAAATGACATGGTGGATCAGATGCATGAAGA

FIG. 17B cont'd

```
TGTAATTAGTTTATGGGATCAAAGCCTCAAGCCATGTGTAAAGTTGACCCCACTCTGTATCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGGCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAATCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W14.13
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGCAGCATATTGTAACATTAATGAAAGTAAATGGAATGAAACTTTACAAAGGGTAAGTAAAAA
ATTAAAAGAATACTTCCCTCATAAGAATATAACATTTCAACCATCCCCAGGAGGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAATACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATGCGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W14.12
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
```

FIG. 17B cont'd

```
AAGAGAGAGAAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGCAGCATATTGTAACATTAATGAAAGTAAATGGAATGAAACTTTACAAAGGGTAAGTAAAAA
ATTAAAAGAATACTTCCCTCATAAGAATATAACATTTCAACCATCCCCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAATACACGAACCATCACAATCCACTGCAGAATAAAACAAATTATAAACAT
GTGGCAGGAGGCTGGGACGAGCAATGTATGCCCCTCCCATTGCAGGAAACATAACATGTATATCAAATATCACAGGAC
TACTATTGACAAGGGATGGAGGAAAAAACAATGCGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGTAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATCAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACGAAACAGATCAACGCGATTAGTGAGCGGATTCTCAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTT
>703010505.W14.8
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACCCTATTTGTGCAT
CAGATGCTAAAGCATATGAGAAAGAAGTGCATAATGTCTGGGCTACACATGCCTGTGTACCCACAGACCCCAATCCA
CAAGAAATGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGAGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAGCAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCGCTGCAGAATAAAACAAATTATAAACAT
GTGGCAGGAGGTGGGACGAGCAATGTATGCCCCTCCCATTGCAGGAAACACAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAAGTGACCTGGATGCAAGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATCAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAGACAGATCAACGCGATTAGTGAGCGGATTCTCAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGCCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W14.36
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
```

FIG. 17B cont'd

CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTATAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGAGGAGAATTTTTCTATTGCAATACATCAAGCCTGTTTAATAGGACATATATGGCTAATAGTACA
GATATGGCTAACAGTACAGAAACTAACAGTACACGAACCATCACAATCCGCTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGTATATTGGAACTC
TAGTTGGAGTAATAAAACTTATGGTGATATTTGGGATAACATGACCTGGATGCAGTGGGAGAGAGAAATTAGCAATT
ATACAGAAATAATATATGAATTGCTTGAAGAATCACAAAACCAGCAGGAAAAGAATGAACAAGATTTACTAGCATTG
GACAGATGGAACAGTCTGTGGAATTGGTTTAACATAACAAATTGGCTGTGGTATATAAAAATATTCATAATGATAGT
AGGAGGCTTGATAGGTTTAAGAATAATTTTTGCTGTGCTTTCTTTAGTAAATAGAGTTAGGCAGGGATACTCACCTC
TGTCGTTGCAGACCCTTATCCCAAGCCCGAGGGGACCAGACAGGCCCGGAGGAATCGAAGAAGAAGGTGGAGAGCAA
GACAGAAACAGATCAACGCGATTAGTGAGCGGATTCTTAGCGCTTGTCTGGGACGACCTGCGGAGCCTGTGCCTTTT
CATCTACCACCGATTGAGAGACTTCATATTAATTGCAGCGAGAGCGGGGGAACTTCTGGGACGCAGCAGTCTCAAGG
GACTACGGAGAGGATGGGAAGCCCTTAAGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGATAGGATTCTAGAATTTGTATTAGGAAT
TTGTAGAGCTATCCGCAACATACCTACAAGAATAAGACAGGGCTTTGAAACAGCTTTGCTATAA
>703010505.W14.35
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTATAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAACAGTACAGAAACTAACAGTACACGAACCATCACAATCCGCTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGTATATTGGAACTC
TAGTTGGAGTAATAAAACTTATGGTGATATTTGGGATAACATGACCTGGATGCAGTGGGAGAGAGAAATTAGCAATT
ATACAGAAATAATATATGAATTGCTTGAAGAATCACAAAACCAGCAGGAAAAGAATGAACAAGATTTACTAGCATTG
GACAGATGGAACAGTCTGTGGAATTGGTTTAACATAACAAATTGGCTGTGGTATATAAAAATATTCATAATGATAGT
AGGAGGCTTGATAGGTTTAAGAATAATTTTTGCTGTGCTTTCTTTAGTAAATAGAGTTAGGCAGGGATACTCACCTC
TGTCGTTGCAGACCCTTATCCCAAGCCCGAGGGGACCAGACAGGCCCGGAGGAATCGAAGAAGAAGGTGGAGAGCAA
GACAGAAACAGATCAACGCGATTAGTGAGCGGATTCTTAGCGCTTGTCTGGGACGACCTGCGGAGCCTGTGCCTTTT
CATCTACCACCGATTGAGAGACTTCATATTAATTGCAGCGAGAGCGGGGGAACTTCTGGGACGCAGCAGTCTCAAGG
GACTACGGAGAGGATGGGAAGCCCTTAAGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGATAGGATTCTAGAATTTGTATTAGGAAT
TTGTAGAGCTATCCGCAACATACCTACAAGAATAAGACAGGGCTTTGAAACAGCTTTGCTATAA
>703010505.W20.10
ATGAGAGTGATGGGGATACAGAGGAATTATCCACAATGGTGGATATGGAACATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTACCAACAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGGCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAGTGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACGACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCGCTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG

FIG. 17B cont'd

```
AGAAGTGAATTATATAAATATAAAGTGGTAGAAGTTAAGCCATTAGGAGTAGCACCCACTAATGTATATTGGAACTC
TAGTTGGAGTAATAAAACTTATGGTGATATTTGGGATAACATGACCTGGATGCAGTGGGAGAGAGAAATTAGCAATT
ATACAGAAATAATATATGAATTGCTTGAAGAATCACAAAACCAGCAGGAAAAGAATGAACAAGATTTACTAGCATTG
GACAGATGGAACAGTCTGTGGAATTGGTTTAACATAACAAATTGGCTGTGGTATATAAAAATATTCATAATGATAGT
AGGAGGGCTTGATAGGTTTAAGAATAATTTTTGCTGTGCTTTCTTTAGTAAATAGAGTTAGGCAGGGATACTCACCTC
TGTCGTTGCAGACCCTTATCCCAAGCCCGAGGGGACCAGACAGGCCCGGAGGAATCGAAGAAGAAGGTGGAGAGCAA
GACAGAAACAGATCAACGCGATTAGTGAGCGGATTCTTAGCGCTTGTCTGGGACGACCTGCGGAGCCTGTGCCTTTT
CATCTACCACCGATTGAGAGACTTCATATTAATTGCAGCGAGAGCGGGGGAACTTCTGGGACGCAGCAGTCTCAAGG
GACTACGGAGAGGATGGGAAGCCCTTAAGTATCTGGGAAGTCTTGTGCAGTATTGGGGCCTGGAACTAAAAAGGAGT
GCTATTAGTCTATTGGATACCCTAGCAATAGCAGTAGGTGAAGGAACAGATAGGATTCTAGAATTTGTATTAGGAAT
TTGTAGAGCTATCCGCAACATACCTACAAGAATAAGACAGGGCTTTGAAACAGCTTTGCTATAA
>703010505.W20.33
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCTGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAATAGGACATATATGGCTAATAGTAC
AATAATTAGATCTGAAAATATAACAAACAATGCCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAGTGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATGGCTAATAGTAC
AGATATGGCTAATAGTACAGAAACTAACAATACACGAACCATCACAATCCACTGCAGAATAAAACAAATTATAAACA
TGTGGCAGGAGGTGGGACGAGCAATGTATGCCCCTCCCATTGCAGGAAACATAACATGTATATCAAATATCACAGGA
CTACTATTGACAAGGGATGGAGGAAAAAACAATACGGAGACATTCAGACCTGGAGGAGGAAATATGAAGGACAATTG
GAGAAGTGAATTATATAAATATAAAGTGGTAGAAGTTAAGCCATTAGGAGTAGCACCCACTAATGTATATTGGAACT
CTAGTTGGAGTAATAAAACTTATGGTGATATTTGGGATAACATGACCTGGATGCAGTGGGAGAAGAAATTAGCAAT
TATACAGAAATAATATATGAATTGCTTGAAGAATCACAAAACCAGCAGGAAAAGAATGAACAAGATTTACTAGCATT
GGACAGATGGAACAGTCTGTGGAATTGGTTTAACATAACAAATTGGCTGTGGTATATAAAAATATTCATAATGATAG
TAGGAGGCTTGATAGGTTTAAGAATAATTTTTGCTGTGCTTTCTTTAGTAAATAGAGTTAGGCAGGGATACTCACCT
CTGTCGTTGCAGACCCTTATCCCAAGCCCGAGGGGACCAGACAGGCCCGGAGGAATCGAAGAAGAAGGTGGAGAGCA
AGACAGAAACAGATCAACGCGATTAGTGAGCGGATTCTTAGCGCTTGCCTGGGACGACCTGCGGAGCCTGTGCCTTT
TCATCTACCACCGATTGAGAGACTTCATATTAATTGCAGCGAGAGCGGGGGAACTTCTGGGACGCAGCAGTCTCAAG
GGACTACGGAGAGGATGGGAAGCCCTTAAGTATCTGGGAAGTCTTGTGCAGTATTGGGGCCTGGAACTAAAAAGGAG
TGCTATTAGTCTATTGGATACCCTAGCAATAGCAGTAGGTGAAGGAACAGATAGGATTCTAGAATTTGTATTAGGAA
TTTGTAGAGCTATCCGCAACATACCTACAAGAATAAGACAGGGCTTTGAAACAGCTTTGCTATAA
>703010505.W20.2
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAACAATGCAATATAATAGAGGGAATGAAAAATTGCTCTTTCAATATAACCACAGAATTAAGAGAT
AAGAGAGAGAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACAGATATGGCTAATAGTACA
GAAACTAACAATACACGAACCATCACAATCCACTGCAGAATAAAACAAATTATAAACATGTGGCAGGAGGTGGGACG
AGCAATGTATGCCCCTCCCATTGCAGGAAACATAACATGTATATCAAATATCACAGGACTACTATTGACAAGGGATG
GAGGAAAAAACAATACGGAGACATTCAGACCTGGAGGAGGAAATATGAAGGACAATTGGAGAAGTGAATTATATAAA
TATAAAGTGGTAGAAGTTAAGCCATTAGGAGTAGCACCCACTAATGCAAGAAGGAGAGTGGTGGAGAGAGAAAAAAG
AGCAGTGGGAATGGGAGCTGTGTTCCTTGGGTTCTTGGGAGCGGCAGGAAGCACTATGGGCGCAGCATCAATAACGC
TGACGGTACGGGCCAGACAATTATTGTCTGGTATAGTGCAACAGCAAAGCAATTTGCTGAAGGCTATAGAGGCTCAA
CAGCATATGTTGAAACTCACGGTCTGGGGCATTAAACAGCTCCAGGCAAGAGTCCTGGCCTTGGAAAGATACCTAAA
GGATCAACTCCTCCTAGGGATGTGGGCTGCTCTGGAAAACTCATCTGCCACCACTAATGTATATTGGAACTCTAGTT
GGAGTAATAAAACTTATGGTGATATTTGGGATAACATGACCTGGATGCAGTGGGAGAGAGAAATTAGCAATTATACA
GAAATAATATATGAATTGCTTGAAGAATCACAAAACCAGCAGGAAAAGAATGAACAAGATTTACTAGCATTGGACAG
ATGGAACAGTCTGTGGAATTGGTTTAACATAACAAATTGGCTGTGGTATATAAAAATATTCATAATGATAGTAGGAG
GCTTGATAGGTTTAAGAATAATTTTTGCTGTGCTTTCTTTAGTAAATAGAGTTAGGCAGGGATACTCACCTCTGTCG
TTGCAGACCCTTATCCCAAGCCCGAGGGGACCAGACAGGCCCGGAGGAATCGAAGAAGAAGGTGGAGAGCAAGACAG
```

FIG. 17B cont'd

```
AAACAGATCAACGCGATTAGTGAGCGGATTCTTAGCGCTTGTCTGGGACGACCTGCGGAGCCTGTGCCTTTTCATCT
ACCACCGATTGAGAGACTTCATATTAATTGCAGCGAGAGCGGGGGAACTTCTGGGACGCAGCAGTCTCAAGGGACTA
CGGAGAGGATGGGAAGCCCTTAAGTATCTGGGAAGTCTTGTGCAGTATTGGGGCCTGGAACTAAAAAGGAGTGCTAT
TAGTCTATTGGATACCCTAGCAATAGCAGTAGGTGAAGGAACAGATAGGATTCTAGAATTTGTATTAGGAATTTGTA
GAGCTATCCGCAACATACCTACAAGAATAAGACAGGGCTTTGAAACAGCTTTGCTATAA
>703010505.W20.36
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCTAATCCA
CAAGAAATGGTTTTAAAAAATGTAACAGAAAATTTCAACATGTGGAAAAATGACATGGTGGATCAGATGCATGAAGA
TGTAATTAGTTTATGGGACCAAAGCCTCAAGCCATGTGTAAAGTTGACCCCACTCTGTGTCACTCTAAACTGTACCA
ATGCTACTGCCAGCAATAGCAATATAATAGAGGGAATGAAAAATTGCTCTTTCAATATAACCACAGAATTAAGAGAT
AAGAGAGAGAAAAAGAATGCACTTTTTTATAAACTTGATATAGTACAGCTAGATGGCAACTCTAGTCAGTATAGATT
AATAAATTGTAATACCCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATAIAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCAAAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAAAAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAAAAT
TTGTATTAGGAATTTGTAGAGCTATCCGCAACATACCTACAAGAATAAGACAGGGCTTTGAAACAGCTTTGCTATAA
>703010505.W20.22
ATGAGAGTGATGGGGATACAGAGGAATTATCCACAATGGTGGATATGGAGCATGTTAGGCTTTTGGATGCTAATGAT
ATGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTACCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAGTGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GTTTTAATTGTGGAGGAGAATTTTTCTATTGCAATACATCAAGCCTGTTTAATAGGACATATATGGCTAATAGCACA
GATATGGCTAATAGTACAGAAACTAACAGTACACGAACCATCACAATCCGCTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
```

FIG. 17B cont'd

```
AGCAGTCTCAAGGGACTACGGAGAGGATGGGAAGCCCTTAAGTATCTGGGAGGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W20.13
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATTAAAGCCTCAAGCCATGTGTAAAGTTGACCCCACTCTGTGTCACTCTAAACTGTACCA
ATGCTACTGCCAACAATAGCAGTATAATAGAGGGAATGAAAAATTGCTCTTTCAATATAACCACAGAATTAAGAGAT
AAGAGAGAGAAAAAGAATGTACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGCCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAGTGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAATCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGCAAGGGATGGAGGAAAAAACAATACTGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCCTTATCCCGAGCCCGAGGGCACCAGACAGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGTAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W20.7
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTAATGCCAGCAATAACAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGCCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAGTGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAATCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCCTTATCCCGAGCCCGAGGGCACCAGACAGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
```

FIG. 17B cont'd

```
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W20.26
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATATCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGGCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGATATAAGAGAAGCATATTGTAACATTAGTGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAATCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACCGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W20.4
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAACAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGGCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAGTGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCGCTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAAACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAAGAATTTGTAGAGCTATCCGCAACATACCTACAAGAATAAGACAGGGCTTTGAAACAGCTTTGCTATAA
```

FIG. 17B cont'd

>703010505.W20.30
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAAGTGTAACAGAAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAACAATAGCAGTATAATAGAGGGAATGAAAAATTGCTCTTTCAATATAACCACAGAATTAAGAGAT
AAGAGAGAGAAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGCCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAAACATAAGAGAAGCATATTGTAACATTAGTGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACACTCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGGCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGAAATCGAAGAAGA
AGGTGGAGAGCAAGCACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAGGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W20.8
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTACATAATGTCTGGGCTACACATGCCTGTGTACCCACAGACCCCAATCCA
CAAGAAATGGTTTTAAAAAATGTAACAGAAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAACAATAGCAGTATAATAGAGGGAATGAAAAATTGCTCTTTCAATATAACCACAGAATTAAGAGAT
AAGAGAGAGAAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGCCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAAACATAAGAGAAGCATATTGTAACATTAGTGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACACTCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGCACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W20.27

FIG. 17B cont'd

```
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAACAATAGCAGTATAATAGAGGGAATGAAAAATTGCTCTTTCAATATAACCACAGAATTAAGAGAT
AAGAGAGAGAAAAGAATGCACTTTTTTTATAAACTTGATATAGTACAACTAGATGGCAACTCTAGTCAGTATAGATT
AATAAATTGTAATACCCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGCCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAAAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACACTCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W20.14
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAACAGTATAATAGAGGGAATGAAAAATTGCTCTTTCAATATAACCACAGAATTAAGAGAT
AAGAGAGAGAAAAGAATGCACTTTTTTTATAAACTTGATATAGTACAACTAGATGGCAACTCTAGTCAGTATAGATT
AATAAATTGTAATACCCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGCCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAAAAGCATATTGTAACATTAGTGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACACTCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W20.15
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
```

FIG. 17B cont'd

```
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTACCAGCAATAGCAGTATAATAGAGGGAATGAAAAATTGCTCTTTCAATATAACCACAGAATTAAGAGAT
AAGAGAGAGAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAGTGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAATACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W20.29
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTACCAGCAATAGCAGTATAATAGAGGGAATGAAAAATTGCTCTTTCAATATAACCACAGAATTAAGAGAT
AAGAGAGAGAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACGAACAGTACACGAACCATCAAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W20.11
ATGAGAGTGATGGGGATACAAAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
```

FIG. 17B cont'd

```
TGTAATTAGTTTATGGGATCAAAGCCTCAAGCCATGTGTAAAGTTGACCCCACTCTGTGTCACTCTAAACTGTACCA
ATGCTACTACCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCCGTGTAATAATGTTAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAAGAAACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCAAAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTAGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W29.32
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTACCAGCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTTAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAAACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCAAAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTAGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAAATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W29.23
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTACCAGCAATAGCAGTATAATAGAGGGAATGAAAAATTGCTCTTTCAATATAACCACAGAATTAAGAGAT
```

FIG. 17B cont'd

```
AAGAGAGAGAAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTGAACTATTGTTAAATGGTAGCCTAGCAGAAGGAGAGAT
AATAATTAGATCTGAAAATATAACAAACAATGCCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAAAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAATACACGAACCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCGG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAATATCTGGGAAGTCTTGTGCAGTATTGGGGCCTGGA
ATTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W20.24
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTACCAGCAATAGCAGTATAATAGAGGGAATGAAAAATTGCTCTTTCAATATAACCACAGAATTAAGAGAT
AAGAGAGAGAAAAAGAATGCACTTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTGAACTATTGTTAAATGGTAGCCTAGCAGAAGGAGAGAT
AATAATTAGATCTGAAAATATAACAAACAATGCCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAAAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAATACAGTACACGAACCATCACAATCCGCTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGATTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCGG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W20.9
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTGCCAGCAATAGCAGTATAATAGAGGGAATGAAAAATTGCTCTTTCAATATAACCACAGAATTAAGAGATAAG
AGAGAGAAAAAGAATGCACTTTTTTATAAACTTGATATAGTACAACTAGATGGCAACTCTAGTCAGTATAGATTAAT
AAATTGTAATACCTCAGTCATAACACAAGCCTGTCCAAAGGTCTCTTTTGACCCAATTCCTATACATTATTGTGCTC
```

FIG. 17B cont'd

```
CAGCTGGTTATGCGATTCTAAAGTGTAATAATAAGACATTCACTGGAACAGGACCGTGTAATAATGTCAGCACAGTA
CAATGTACACATGGAATTAAGCCAGTGGTTTCAACTCAACTATTGTTAAATGGTAGCCTAGCAGAAGGAGAGATAAT
AATTAGATCTGAAAATATAACAAACAATGCCAAAACAATAATAGTACATCTCAATGAATCTGTAAAGATTGAGTGTA
CGAGACCCAATAATAAAACAAGAACAAGTATAAGAATAGGACCAGGACAAGCATTTTATGCAACAGGACAAGTAATA
GGAGACATAAGAAAAGCATATTGTAACATTAATGAAAGTAAATGGAATGAAACTTTACAAAGGGTAAGTAAAAAATT
AAAAGAATACTTCCCTCATAAGAATATAACATTTCAACCATCCTCAGGAGGGGACCTAGAAATTACAACACATAGCT
TTAATTGTGGAGGAGAATTTTTCTATTGCAATACATCAAGCCTGTTTAATAGGACATATATGGCTAATAGTACAGAT
ATGGCTAATAGTACAGAAACTAACAATACACGAACCATCACAATCTCACTGCAGAATAAAACAAATTATAAACATGTG
GCAGGAGGTGGGACGAGCAATGTATGCCCCTCCCATTGCAGGAAACATAACATGTATATCAAATATCACAGGACTAC
TATTGACAAGGGATGGAGGAAAAAACAATACGGAGACATTCAGACCTGGAGGAGGAAATATGAAGGACAATTGGAGA
AGTGAATTATATAAATATAAAGTGGTAGAAGTTAAGCCATTAGGAGTAGCACCCACTAATGCAAGAAGGAGAGTGGT
GGAAAGAGAAAAAAGAGCAGTGGGAATGGGAGCTGTGTTCCTTGGGTTCTTGGGAGCGGCAGGAAGCACTATGGGCG
CAGCATCAATAACGCTGACGGTACAGGCCAGACAATTATTGTCTGGTATAGTGCAACAGCAAAGCAATTTGCTGAAG
GCTATAGAGGCTCAACAGCATATGTTGAAACTCACGGTCTGGGGCATTAAACAGCTCCAGGCAAGAGTCCTGGCCTT
GGAAAGATACCTAAAGGATCAACAGCTCCTAGGGATGTGGGGCTGCTCTGGAAAACTCATCTGCACCACTAATGTAT
ATTGGAACTCTAGTTGGAGTAATAAAACTTATGGTGATATTTGGGATAACATGACCTGGATGCAGTGGGAGAGAGAA
ATTAGCAATTATACAGAAATAATATATGAATTGCTTGAAGAATCACAAAACCAGCAGGAAAAGAATGAACAAGATTT
ACTAGCATTGGACAGATGGAACAGTCTGTGGAATTGGTTTAACATAACAAATTGGCTGTGGTATATAAAAATATTCA
TAATGATAGTAGGAGGCTTGATAGGTTTAAGAATAATTTTTGCTGTGCTTTCTTTAGTAATAGAGTTAGGCAGGGA
TACTCACCTCTGTCGTTGCAGACCCTTATCCCAAGCCCGAGGGGACCAGACAGGCCCGGAGGAATCGAAGAAGAAGG
TGGAGAGCAAGACAGAAACAGATCAACGCGATTAGTGAGCGGATTCTTAGCGCTTGCCTGGGACGACCTGCGGAGCC
TGTGCCTTTTCATCTACCACCGATTGAGAGACTTCATATTAATTGCAGCGAGAGCGGGGGAACTTCTGGGACGCAGC
AGTCTCAAGGGACTACGGAGAGGATGGGAAGCCCTTAAGTATCTGGGAAGTCTTGTGCAGTATTGGGGCCTGGAACT
AAAAAGGAGTGCTATTAGTCTATTGGATACCCTAGCAATAGCAGTAGGTGAAGGAACAGATAGGATTCTAGAATTTG
TATTAGGAATTTGTAGAGCTATCCGCAACATACCTACAAGAATAAGACAGGGCTTTGAAACAGCTTTGCTATAA
>703010505.W20.21
ATGAGAGTGATGGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTGCCAGCAATAGCAGTATAATAGAGGGAATGAAAAATTGCTCTTTCAATATAACCACAGAATTAAGAGATAAG
AGAGAGAAAAGAATGCACTTTTTTATAAACTTGATATAGTACAACTAGATGGCAACTCTAGTCAGTATAGATTAAT
AAATTGTAATACCTCAGTCATAACACACGCCTGTCCAAAGGTCTCTTTTGACCCAATTCCTATACATTATTGTGCTC
CAGCTGGTTATGCGATTCTAAAGTGTAATAATAAGACATTCACTGGAACAGGACCGTGTAATAATGTCAGCACAGTA
CAATGTACACATGGAATTAAGCCAGTGGTTTCAACTCAACTATTGTTAAATGGTAGCCTAGCAGAAGGAGAGATAAT
AATTAGATCTGAAAATATAACAAACAATGCCAAAACAATAATAGTACATCTCAATGAATCTGTAAAGATTGAGTGTA
CGAGACCCAATAATAAAACAAGAACAAGTATAAGAATAGGACCAGGACAAGCATTTTATGCAACAGGACAAGTAATA
GGAGACATAAGAAAAGCATATTGTAACATTAATGAAAGTAAATGGAATGAAACTTTACAAAGGGTAAGTAAAAAATT
AAAAGAATACTTCCCTCATAAGAATATAACATTTCAACCATCCTCAGGAGGGGACCTAGAAATTACAACACATAGCT
TTAATTGTGGAGGAGAATTTTTCTATTGCAATACATCAAGCCTGTTTAATAGGACATATATGGCTAATAGTACAGAT
ATGGCTAATAGTACAGAAACTAACAATACACGAACCATCACAATCTCACTGCAGAATAAAACAAATTATAAACATGTG
GCAGGAGGTGGGACGAGCAATGTATGCCCCTCCCATTGCAGGAAACATAACATGTATATCAAATATCACAGGACTAC
TATTGACAAGGGATGGAGGAAAAAACAATACGGAGACATTCAGACCTGGAGGAGGAAATATGAAGGACAATTGGAGA
AGTGAATTATATAAATATAAAGTGGTAGAAGTTAAGCCATTAGGAGTAGCACCCACTAATGCAAGAAGGAGAGTGGT
GGAGAGAGAAAAAAGAGCAGTGGGAATGGGAGCTGTGTTCCTTGGGTTCTTGGGAGCGGCAGGAAGCACTATGGGCG
CAGCATCAATAACGCTGACGGTACAGGCCAGACAATTATTGTCTGGTATAGTGCAACAGCAAAGCAATTTGCTGAAG
GCTATAGAGGCTCAACAGCATATGTTGAAACTCACGGTCTGGGGCATTAAACAGCTCCAGGCAAGAGTCCTGGCCTT
GGAAAGATACCTAAAGGATCAACAGCTCCTAGGGATGTGGGGCTGCTCTGGAAAACTCATCTGCACCACTAATGTAT
ATTGGAACTCTAGTTGGAGTAATAAGACTTATGGTGATATTTGGGATAACATGACCTGGATGCAGTGGGAGAGAGAA
ATTAGCAATTATACAGAAATAATATATGAATTGCTTGAAGAATCACAAAACCAGCAGGAAAAGAATGAACAAGATTT
ACTAGCATTGGACAGATGGAACAGTCTGTGGAATTGGTTTAACATAACAAATTGGCTGTGGTATATAAAAATATTCA
TAATGATAGTAGGAGGCTTGATAGGTTTAAGAATAATTTTTGCTGTGCTTTCTTTAGTAATAGAGTTAGGCAGGGA
TACTCACCTCTGTCGTTGCAGACCCTTATCCCAAGCCCGAGGGGACCAGACAGGCCCGGAGGAATCGAAGAAGAAGG
TGGAGAGCAAGACAGAAACAGATCAACGCGATTAGTGAGCGGATTCTTAGCGCTTGCCTGGGACGACCTGCGGAGCC
TGTGCCTTTTCATCTACCACCGATTGAGAGACTTCATATTAATTGCAGCGAGAGCGGGGGAACTTCTGGGACGCAGC
AGTCTCAAGGGACTACGGAGAGGATGGGAAGCCCTTAAGTATCTGGGAAGTCTTGTGCAGTATTGGGGCCTGGAACT
AAAAAGGAGTGCTATTAGTCTATTGGATACCCTAGCAATAGCAGTAGGTGAAGGAACAGATAGGATTCTAGAATTTG
TATTAGGAATTTGTAGAGCTATCCGCAACATACCTACAAGAATAAGACAGGGCTTTGAAACAGCTTTGCTATAA
>703010505.W20.6
ATGAGAGTGATGGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAGATTTCAACATGTGGAAAAATGACATGGTGGATCAGATGCATGAAG
ATGTAATTAGTTTATGGGATCAAAGCCTCAAGCCATGTGTAAAGTTGACCCCACTCTGTGTCACTCTAAACTGTACC
AATGCTAATGCCAGCAATAGCAGTATAATAGAGGGAATGAAAAATTGCTCTTTCAATATAACCACAGAATTAAGAGA
TAAGAGAGAGAAAAGAATGCACTTTTTTATAAACTTGATATAGTACAACTAGATGGCAACTCTAGTCAGTATAGAT
TAATAAATTGTAATACCTCAGTCATAACACAAGCCTGTCCAAAGGTCTCTTTTGACCCAATTCCTATACATTATTGT
GCTCCAGCTGGTTATGCGATTCTAAAGTGTAATAATAAGACATTCACTGGAACAGGACCGTGTAATAATGTCAGCAC
AGTACAATGTACACATGGAATTAAGCCAGTGGTTTCAACTCAACTATTGTTAAATGGTAGCCTAGCAGAAGGAGAGA
```

FIG. 17B cont'd

```
TAATAATTAGATCTGAAAATATAACAAACAATGGCAAAACAATAATAGTACATCTCAATGAATCTGTAAAGATTGAG
TGTACGAGACCCAATAATAAAACAAGAACAAGTATAAGAATAGGACCAGGACAAGCATTTTATGCAACAGGACAAGT
AATAGGAGACATAAGAGAAGCATATTGTAACATTAGTGAAAGTAAATGGAATGAAACTTTACAAAGGGTAAGTAAAA
AATTAAAAGAATACTTCCCTCATAAGAATATAACATTTCAACCATCCTCAGGAGGGGACCTAGAAATTACAACACAT
AGCTTTAATTGTGGAGGAGAATTTTTCTATTGCAATACATCAAGCCTGTTTAATAGGACATATATGGCTAATAGTAC
AGATATGGCTAATAGTACAGAAACTAACAGAACCATCACAATCCACTGCAGAATAAAACAAATTATAAACATGTGGC
AGGAGGTGGGACGAGCAATGTATGCCCCTCCCATTGCAGGAAACATAACATGTATATCAAATATCACAGGACTACTA
TTGACAAGGGATGGAGGAAAAAACAATACCGGAGACATTCAGACCTGGAGGAGGAAATATGAAGGACAATTGGAGAAG
TGAATTATATAAATATAAAGTGGTAGAAGTTAAGCCATTAGGAGTAGCACCCACTAATGCAAGAAGGAGAGTGGTGG
AGAGAGAAAAAAGAGCAGTGGGAATGGGAGCTGTGTTCCTTGGGTTCTTGGGAGCGGCAGGAAGCACTATGGGCGCA
GCATCAATAACGCTGACGGTACAGGCCAGACAATTATTGTCTGGTATAGTGCAACAGCAAAGCAATTTGCTGAAGGC
TATAGAGGCTCAACAGCATATGTTGAAACTCACGGTCTGGGGCATTAAACAGCTCCAGGCAAGAGTCCTGGCCTTGG
AAAGATACCTAAAGGATCAACAGCTCCTAGGGATGTGGGGCTGCTCTGGAAAACTCATCTGCACCACTAATGTATAT
TGGAACTCTAGTTGGAGTAATAAAACTTATGGTGATATTTGGGATAACATGACCTGGATGCAGTGGGAGAGAGAAAT
TAGCAATTATACAGAAATAATATATGAATTGCTTGAAGAATCGCAAAACCAGCAGGAAAAGAATGAACAAGATTTAC
TAGCATTGGACAGATGGAACAGTCTGTGGAATTGGTTTAACATAACAAATTGGCTGTGGTATATAAAAAATATTCATA
ATGATAGTAGGAGGCTTGATAGGTTTAAGAATAATTTTTGCTGTGCTTTCTTTAGTAAATAGAGTTAGGCAGGGATA
CTCACCTCTGTCGTTGCAGACCCTTATCCCAAGCCCGAGGGGACCAGACAGGCCCGGAGGAATCGAAGAAGAAGGTG
GAGAGCAAGACAGAAACAGATCAACGCGATTAGTGAGCGGATTCTTAGCGCTTGTCTGGGACGACCTGCGGAGCCTG
TGCCTTTTCATCTACCACCGATTGAGAGACTTCACATTAATTGCAGCGAGAGCGGGGGAACTTCTGGGACGCAGCAG
TCTCAAGGGACTACGGAGAGGATGGGAAGCCCTTAAGTATCTGGGAAGTCTTGTGCAGTATTGGGGCCTGGAACTAA
AAAGGAGTGCTATTAGTCTATTGGATACCCTAGCAATAGCAGTAGGTGAAGGAACAGATAGGATTCTAGAATTTGTA
TTAGGAATTTGTAGAGCTATCCGCAACATACCTACAAGAATAAGACAGGGCTTTGAAACAGCTTTGCTATAA
>703010505.W29.19
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATGCTACTGCCAGCAATAGCAGTATAATAGAGGGAATGAAAAATTGCTCTTTCAATATAACC
ACAGAATTAAGAGATAAGAGAGAGAAAAAGAATGCACTTTTTTATAAACTTGATATAGTACAACTAGATGGCAACTC
TAGTCAGTATAGATTAATAAATTGTAATACCTCAGTCATAACACAAGCCTGTCCAAAGGTCTCTTTTGACCCAATTC
CTATACATTATTGTGCTCCAGCTGGTTATCGCGATTCTAAAGTGTAATAATAAGACATTCACTGGAACAGGACCGTGT
AATAATGTCAGCACAGTACAATGTACACATGGAATTAAGCCAGTGGTTTCTACTCAACTATTGTTAAATGGTAGCCT
AGCAGAAGGAGAGATAATAATTAGATCTGAAAATATAACAAACAATGTCAAAACAATAATAGTACATCTCAATGAAT
CTGTAAAGATTGAGTGTACGAGACCCAATAATAAAACAAGAAAAAGTATAAGAATAGGACCAGGACAAGCATTTTAT
GCAACAGGACAAGTAATAGGAGACATAAGAGAAGCATATTGTAACATTAGTGAAAGTAAATGGAATGAAACTTTACA
AAGGGTAAGTAAGTAAAAATTAAAAGAATACTTCCCTCATAAGAATATACTTCCCTCATAAGAATATCCAACCATCCTCAGGAGGGGACCTAG
AAATTACAACACATAGCTTTAATTGTGGAGGAGAATTTTTCTATTGCAATACATCAAGCCTGTTTAATAGGACATAT
ATGGCTAATAGTACAGATATGGCTAATAGTACAGAAACTAACAGTACACGAACCATCACAATCCGCTGCAGAATAAA
ACAAATTATAAACATGTGGCAGGAGGTGGGACGAGCAATGTATGCCCCTCCCATTGCAGGAAACATAACATGTATAT
CAAATATCACAGGACTACTATTGACAAGGGATGGAGGAAAAAACAATACCGGAGACATTCAGACCTGGAGGAGGAAAT
ATGAAGGACAATTGGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGTTGGAGTAATAAAACTTATGGTGATATTTGGGATAACATGACCTGG
ATGCAGTGGGAGAGAGAAATTAGCAATTATACAGAAATAATATATGAATTGCTTGAAGAATCGCAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
ATAGAGTTAGGCAGGGATACTCACCTCTGTCGTTACAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGTCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTGCTCAAGGGACAGGAGGATGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAAGGAACAG
ATAGGATTCTAGAATTTGTATTAGGAATTTGTAGAGCTATCCGCAACATACCTACAAGAATAAGACAGGGCTTTGAA
ACAGCTTTGCTATAA
>703010505.W29.25
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATGCTACTGCCAGCAATAGCAGTATAATAGAGGGAATGAAAAATTGCTCTTTCAATATAACC
ACAGAATTAAGAGATAAGAGAGAGAAAAAGAATGCACTTTTTTATAAACTTGATATAGTACAACTAGATGGCAACTC
TAGTCAGTATAGATTAATAAATTGTAATACCTCAGTCATAACACAAGCCTGTCCAAAGGTCTCTTTTGACCCAATTC
CTATACATTATTGTGCTCCAGCTGGTTATCGCGATTCTAAAGTGTAATAATAAGACATTCACTGGAACAGGACCGTGT
AATAATGTCAGCACAGTACAATGTACACATGGAATTAAGCCAGTGGTTTCTACTCAACTATTGTTAAATGGTAGCCT
AGCAGAAGGAGAGATAATAATTAGATCTGAAAATATAACAAACAATGTCAAAACAATAATAGTACATCTCAATGAAT
```

FIG. 17B cont'd

```
CTGTAAAGATTGAGTGTACGAGACCCAATAATAAAACAAGAAAAAGTATAAGAATAGGACCAGGACAAGCATTTTAT
GCAACAGGACAAGTAATAGGAGACATAAGAGAAGCATATTGTAACATTAATGAAAGTAAATGGAATGAAACTTTACA
AAGGGTAAGTAAAAAATTAAAAGAATACTTCCCTCATAAGAATATAACATTTCAACCATCCTCAGGAGGGGACCTAG
AAATTACAACACATAGCTTTAATTGTGGAGGAGAATTTTTCTATTGCAATACATCAAGCCTGTTTAATAGGACATAT
ATGGCTAATAGTACAGATATGGCTAATAGTACAGAAACTAACAGTACACGAACCATCACAATCCGCTGCAGAATAAA
ACAAATTATAAACATGTGGCAGGAGGTGGGACGAGCAATGTATGCCCCTCCCATTGCAGGAAACATAACATGTATAT
CAAATATCACAGGACTACTATTGACAAGGGATGGAGGAAAAAACAATACGGAGACATTCAGACCTGGAGGAGGAAAT
ATGAAGGACAATTGGAGAAGTGAATTATATAAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGTTGGAGTAATAAAACTTATGGTGATATTTGGGATAACATGACCTGG
ATGCAGTGGGAGAGAGAAATTAGCAATTATACAGAAATAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCGTTACAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGTCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGATGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAAGGAACAG
ATAGGATTCTAGAATTTGTATTAGGAATTTGTAGAGCTATCCGCAACATACCTACAAGAATAAGACAGGGCTTTGAA
ACAGCTTTGCTATAA
>703010505.W29.13
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATGCTACTGCCAGCAATAGCAGTATAATAGAGGGAATGAAAAATTGCTCTTTCAATATAACC
ACAGAATTAAGAGATAAGAGAGAGAAAAAGAATGCACTTTTTTATAAACTTGATATAGTACAACTAGATGGCAACTC
TAGTCAGTATAGATTAATAAATTGTAATACCTCAGTCATAACACAAGCCTGTCCAAAGGTCTCTTTTGACCCAATTC
CTATACATTATTGTGCTCCAGCTGGTTATGCGATTCTAAAGTGTAATAATAAGACATTCACTGGAACAGGACCGTGT
AATAATGTCAGCACAGTACAATGTACACATGGAATTAAGCCAGTGGTTTCTACTCAACTATTGTTAAATGGTAGCCT
AGCAGAAGGAGAGATAATAATTAGATCTGAAAATATAACAAACAATGTCAAAACAATAATAGTACATCTCAATGAAT
CTGTAAAGATTGAGTGTACGAGACCCAATAATAAAACAAGAAAAAGTATAAGAATAGGACCAGGACAAGCATTTTAT
GCAACAGGACAAGTAATAGGAGACATAAGAGAAGCATATTGTAACATTAATGAAAGTAAATGGAATGAAACTTTACA
AAGGGTAAGTAAAAAATTAAAAGAATATTTCCCTCATAAGAATATAACATTTCAACCATCCTCAGGAGGGGACCTAG
AAATTACAACACATAGCTTTAATTGTGGAGGAGAATTTTTCTATTGCAATACATCAAGCCTGTTTAATAGGACATAT
ATGGCTAATAGTACAGATATGGCTAATAGTACAGAAACTAACAGTACACGAACCATCACAATCCGCTGCAGAATAAA
ACAAATTATAAACATGTGGCAGGAGGTGGGACGAGCAATGTATGCCCCTCCCATTGCAGGAAACATAACATGTATAT
CAAATATCACAGGACTACTATTGACAAGGGATGGAGGAAAAAACAATACGGAGACATTCAGACCTGGAGGAGGAAAT
ATGAAGGACAATTGGAGAAGTGAATTATATAAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGTTGGAGTAATAAAACTTATGGTGATATTTGGGATAACATGACCTGG
ATGCAGTGGGAGAGAGAAATTAGCAATTATACAGAAATAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCGTTACAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGTCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGATGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAAGGAACAG
ATAGGATTCTAGAATTTGTATTAGGAATTTGTAGAGCTATCCGCAACATACCTACAAGAATAAGACAGGGCTTTGAA
ACAGCTTTGCTATAA
>703010505.W29.34
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATGCTACTGCCAGCAATAGCAGTATAATAGAGGGAATGAAAAATTGCTCTTTCAATATAACC
ACAGAATTAAGAGATAGGAGAGAGAAAAAGAATGCACTTTTTTATAAACTTGATATAGTACAACTAGATGGCAACTC
TAGTCAGTATAGATTAATAAATTGTAATACCTCAGTCATAACACAAGCCTGTCCAAAGGTCTCTTTTGACCCAATTC
CTATACATTATTGTGCTCCAGCTGGTTATGCGATTCTAAAGTGTAATAATAAGACATTCACTGGAACAGGACCGTGT
AATAATGTCAGCACAGTACAATGTACACATGGAATTAAGCCAGTGGTTTCAACTCAACTATTGTTAAATGGTAGCCT
AGCAGAAGGAGAAATAATAATTAGATCTGAAAATATAACAAACAATGCCAAAACAATAATAGTACATCTCAATGAAT
```

FIG. 17B cont'd

```
CTGTAAAGATTGAGTGTACGAGACCCAATAATAAAACAAGAACAAGTATAAGAATAGGACCAGGACAAGCATTTTAT
GCAACAGGACAAGTAATAGGAGACATAAGAGCAGCATATTGTAACATTAATGAAAGTAAATGGAATGAAACTTTACA
AAGGGTAAGTAAAAAATTAAAAGAATACTTCCCTCATAAGAATATAACATTTCAACCATCCTCAGGAGGGGACCTAG
AAATTACAACACATAGCTTTAATTGTGGAGGAGAATTTTTCTATTGCAATACATCAAGCCTGTTTAATAGGACATAT
ATGGCTAATAGTACAGATATGGCTAATAGTACAGAAACTAACAGTACACGAACCATCACAATCCGCTGCAGAATAAA
ACAAATTATAAACATGTGGCAGGAGGTGGGACGAGCCTTATCCCTCCCATTGCAGGAAACATAACATGTATAT
CAAATATCACAGGACTACTATTGACAAGGGATGGAGGAAAAAACAATACGGAGACATTCAGACCTGGAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGTTGGAGTAATAAAACTTATGGTGATATTTGGGATAACATGACCTGG
ATGCAGTGGGAGAGAGAAATTAGCAATTATACAGAAATAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCGTTGCAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGTCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGATGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAAGGAACAG
ATAGGATTCTAGAATTTGTATTAGGAATTTGTAGAGCTATCCGCAACATACCTACAAGAATAAGACAGGGCTTTGAA
ACAGCTTTGCTATAA
>793016505.W29.28
ATGAGAGTGATGGGGATACAGAGGAATTATCCACAATGGTGGATATGGAGCATGTTAGGCTTTTGGATGCTAATGAT
TTGTAACGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
CGTAATTAGTTTATGGGATCAAAGCCTCAAGCCATGTGTAAAGTTGACCCCACTCTGTGTCACTCTAAACTGTACCA
ATGCTACTGCCAGCAATACCAATGCTACTGCCAGCAATAGCAGTATAATAGAGGGAATGAAAAATTGCTCTTTCAAT
ATAACCACAGAATTAAGAGATAGGAGAGAGAAAAAGAATGCACTTTTTTATAAACTTGATATAGTACAACTAGATGG
CAACTCTAGTCAGTATAGATTAATAAATTGTAATACCTCAGTCATAACACAAGCCTGTCCAAAGGTCTCTTTTGACC
CAATTCCTATACATTATTGTGCTCCAGCTGGTTATGCGATTCTAAAGTGTAATAATAAGACATTCACTGGAACAGGA
CCGTGTAATAATGTCAGCACAGTACAATGTACACATGGAATTAAGCCAGTGGTTTCAACTCAACTATTGTTAAATGG
TAGCCTAGCAGAAGGAGAGATAATAATTAGATCTGAAAATATAACAAACAATGCCAAAACAATAATAGTACATCTCA
ATGAATCTGTAAAGATTGAGTGTACGAGACCCAATAATAAAACAAGAACAAGTATAAGAATAGGACCAGGACAAGCA
TTTTATGCAACAGGACAAGTAATAGGAGACATAAGAGAAGCATATTGTAACATTAATGAAAGTAAATGGAATGAAAC
TTTACAAAGGGTAAGTAAAAAATTAAAAGAATACTTCCCTCATAAGAATATAACATTTCAACCATCCTCAGGAGGGG
ACCTAGAAATTACAACACATAGCTTTAATTGTGGAGGAGAATTTTTCTATTGCAATACATCAAGCCTGTTTAATAGG
ACATATATGGCTAATAGTACAGATATGGCTAATAGTACAGAAACTAACAGTACACGAACCATCACAATCCGCTGCAG
AATAAAACAAATTATAAACATGTGGCAGGAGGTGGGACGAGCAATGTATGCCCCTCCCATTGCAGGAAACATAACAT
GTATATCAAATATCACAGGACTACTATTGACAAGGGATGGAGGAAAAAACAATACGGAGACATTCAGACCTGGAGGA
GGAAATATGAAGGACAATTGGAGAAGTGAATTATATAAATATAAAGTGGTAGAAGTTAAGCCATTAGGAGTAGCACC
CACTAATGCAAGAAGGAGAGTGGTGGAGAGAGAAAAAAGAGCAGTGGGAATGGGAGCTGTGTTCCTTGGGTTCTTGG
GAGCGGCAGGAAGCACTATGGGCGCAGCATCAATAACGCTGACGGTACAGGCCAGACAATTATTGTCTGGTATAGTG
CAACAGCAAAGCAATTTGCTGAAGGCTATAGAGGCTCAACAGCATATGTTGAAACTCACGGTCTGGGGCATTAAACA
GCTCCAGGCAAGAGTCCTGGCCTTGGAAAGATACCTAAAGGATCAACAGCTCCTAGGGATGTGGGGCTGCTCTGGAA
AACTCATCTGCACCACTAATGTATATTGGAACTCTAGTTGGAGTAATAAAACTTATGGTGATATTTGGGATAACATG
ACCTGGATGCAGTGGGAGAGAGAAATTAGCAATTATACAGAAATAATATATGAATTGCTTGAAGAATCACAAAACCA
GCAGGAAAAGAATGAACAAGATTTACTAGCATTGGACAGATGGAACAGTCTGTGGAATTGGTTTAACATAACAAATT
GGCTGTGGTATATAAAAATATTCATAATGATAGTAGGAGGCTTGATAGGTTTAAGAATAATTTTTGCTGTGCTTTCT
TTAGTAAATAGAGTTAGGCAGGGATACTCACCTCTGTCGTTGCAGACCCTTATCCCAAGCCCGAGGGGACCAGACAG
GCCCGGAGGAATCGAAGAAGAAGGTGGAGAGCAAGACAGAAACAGATCAACGCGATTAGTGAGCGGATTCTTAGCGC
TTGTCTGGGACGACCTGCGGAGCCTGTGCCTTTTCATCTACCACCGATTGAGAGACTTCATATTAATTGCAGCGAGA
GCGGGGGAACTTCTGGGACGCAGCAGTCTCAAGGGACTACGGAGAGGATGGGAAGCCCTTAAGTATCTGGGAAGTCT
TGTGCAGTATTGGGGCCTGGAACTAAAAAGGAGTGCTATTAGTCTATTGGATACCCTAGCAATAGCAGTAGGTGAAG
GAACAGATAGGATTCTAGAATTTGTATTAGGAATTTGTAGAGCTATCCGCAACATACCTACAAGAATAAGACAGGGC
TTTGAAACAGCTTTGCTATAA
>793016505.W29.3
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATACCAATGCTACTGCCAGCAATAGCAGTACAATAGAGGGAATGAAAAATTGCTCTTTCAAT
ATAACCACAGAATTAAGAGATAGGAGAGAGAAAAAGAATGCACTTTTTTATAAACTTGATATAGTACAACTAGATGG
CAACTCTAGTCAGTATAGATTAATAAATTGTAATACCTCAGTCATAACACAAGCCTGTCCAAAGGTCTCTTTTGACC
CAATTCCTATACATTATTGTGCTCCAGCTGGTTATGCGATTCTAAAGTGTAATAATAAGACATTCACTGGAACAGGA
CCGTGTAATAATGTCAGCACAGTACAATGTACACATGGAATTAAGCCAGTGGTTTCAACTCAACTATTGTTAAATGG
TAGCCTAGCAGAAGGAGAGATAATAATTAGATCTGAAAATATAACAAACAATGCCAAAACAATAATAGTACATCTCA
```

FIG. 17B cont'd

ATGAATCTGTAAAGATTGAGTGTACGAGACCCAATAATAAAACAAGAACAAGTATAAGAATAGGACCAGGACAAGCA
TTTTATGCAACAGGACAAGTAATAGGAAACATAAGAGAAGCATATTGTAACATTAGTGAAAGTAAATGGAATGAAAC
TTTACAAAGGGTAAGTAAAAAATTAAAAGAATACTTCCCTCATAAGAATATAACATTTCAACCATCCTCAGGAGGGG
ACCTAGAAATTACAACACATAGCTTTAATTGTGGAGGAGAATTTTTCTATTGCAATACATCAAGCCTGTTTAATAGG
ACATATATGGCTAATAGTACAGATATGGCTAATAGTACAGAAACTAACAGTACACGAATCATCACAATCCACTGCAG
AATAAAACAAATTATAAACATGTGGCAGGAGGTGGGACGAGCAATGTATGCCCCTCCCATTGCAGGAAACATAACAT
GTATATCAAATATCACAGGACTACTATTGACAAGGGATGGAGGAAAAAACAATACGGAGACATTCAGACCTGGAGGA
GGAAATATGAAGGACAATTGGAGAAGTGAATTATATAAATATAAAGTGGTAGAAGTTAAGCCATTAGGAGTAGCACC
CACTAATGCAAGAAGGAGAGTGGTGGAGAGAGAAAAAAGAGCAGTGGGAATGGGAGCTGTGTTCCTTGGGTTCTTGG
GAGCGGCAGGAAGCACTATGGGCGCAGCATCAATAACGCTGACGGTACAGGCCAGACAATTATTGTCTGGTATAGTG
CAACAGCAAAGCAATTTGCTGAAGGCTATAGAGGCTCAACAGCATATGTTGAAACTCACGGTCTGGGGCATTAAACA
GCTCCAGGCAAGAGTCCTGGCCTTGGAAAGATACCTAAAGGATCAACAGCTCCTAGGGATGTGGGGCTGCTCTGGAA
AACTCATCTGCACCACTAATGTATATTGGAACTCTAGTTGGAGTAATAAAACTTATGGTGATATTTGGGATAACATG
ACCTGGATACAGTGGGAGAGAGAAATTAGCAATTATACAGAAATAATATATGAATTGCTTGAAGAATCACAAAACCA
GCAGGAAAAGAATGAACAAGATTTACTAGCATTGGACAGATGGAACAGTCTGTGGAATTGGTTTAACATAACAAATT
GGCTGTGGTATATAAAAATATTCATAATGATAGTAGGAGGCTTGATAGGTTTAAGAATAATTTTTGCTGTGCTTTCT
TTAGCAAATAGAGTTAGGCAGGGATACTCACCTCTGTCGTTGCAGACCCTTATCCCAAGCCCGAGGGGACCAGACAG
GCCCGGAGGAATCGAAGAAGAAGGTGGAGAGCAAGACAGAAACAGATCAACGCGATTAGTGAGCGGATTCTTAGCGC
TTGTCTGGGACGACCTGCGGAGCCTGTGCCTTTTCATCTACCACCGATTGAGAGACTTCATATTAATTGCAGCGAGA
GCGGGGGAACTTCTGGGACGCAGCAGTCTCAAGGGACTACGGAGAGGATGGGAAGCCCTTAAGTATCTGGGAAGTCT
TGTGCAGTATTGGGGCCTGGAACTAAAAAGGAGTGCTATTAGTCTATTGGATACCCTAGCAATAGCAGTAGGTGAAG
GAACAGATAGGATTCTAGAATTTGTATTAGGAATTTGTAGAGCTATCCGCAACATACCTACAAGAATAAGACAGGGC
TTTGAAACAGCTTTGCTATAA
>703010505.W22.20
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATACCAATGCTACTGCCAACAATAGCAGTATAATAGAGGGAATGAAAAATTGCTCTTTCAAT
ATAACCACAGAATTAAGAGATAAGAGAGAGAAAAAGAATGCACTTTTTTATAAACTTGATATAGTACAACTAGATGG
CAACTCTAGTCAGTATAGATTAATAAATTGTAATACCTCAGTCATAACACAAGCCTGTCCAAAGGTCTCTTTTGACC
CAATTCCTATACATTATTGTGCTCCAGCTGGTTATGCGATTCTAAAGTGTAATAATAAGACATTCACTGGAACAGGA
CCGTGTAATAATGTCAGCACAGTACAATGTACACATGGAATTAAGCCAGTGGTTTCAACTCAACTATTGTTAAATGG
TAGCCTAGCAGAAGGAGAGATAATAATTAGATCTGAAAATATAACAAACAATGCCAAAACAATAATAGTACATCTCA
ATGAATCTGTAAAGATTGAGTGTACGAGACCCAATAATAAAACAAGAACAAGTATAAGAATAGGACCAGGACAAGCA
TTTTATGCAACAGGAGACAAGTAATAGGAGACATTAGTGCAACATTAGTGAACATTAGTGAAAGTAAATGGAATGAAAC
TTTACAAAGGGTAAGTAAAAAATTAAAAGAATACTTCCCTCATAAGAATATAACATTTCAACCATCCTCAGGAGGGG
ACCTAGAAATTACAACACATAGCTTTAATTGTGGAGGAGAATTTTTCTATTGCAATACATCAAGCCTGTTTAATAGG
ACATATATGGCTAATAGTACAGATATGGCTAATAGTACAGAAACTAACAGTACACGAACCATCACAATCCGCTGCAG
AATAAAACAAATTATAAACATGTGGCAGGAGGTGGGACGAGCAGTGTATGCCCCTCCCATTGCAGGAAACATAACAT
GTATATCAAATATCACAGGACTACTATTGACAAGGGATGGAGGAAAAAACAATACGGAGACATTCAGACCTGGAGGA
GGAAATATGAAGGACAATTGGAGAAGTGAATTATATAAATATAAAGTGGTAGAAGTTAAGCCATTAGGAGTAGCACC
CACTAATGCAAGAAGGAGAGTGGTGGAGAGAGAAAAAAGAGCAGTGGGAATGGGAGCTGTGTTCCTTGGGTTCTTGG
GAGCGGCAGGAAGCACTATGGGCGCAGCATCAATAACGCTGACGGTACAGGCCAGACAATTATTGTCTGGTATAGTG
CAACAGCAAAGCAATTTGCTGAAGGCTATAGAGGCTCAACAGCATATGTTGAAACTCACGGTCTGGGGCATTAAACA
GCTCCAGGCAAGAGTCCTGGCCTTGGAAAGATACCTAAAGGATCAACAGCTCCTAGGGATGTGGGGCTGCTCTGGAA
AACTCATCTGCACCACTAATGTATATTGGAACTCTAGTTGGAGTAATAAAACTTATGGTGATATTTGGGATAACATG
ACCTGGATGCAGTGGGAGAGAGAAATTAGCAATTATACAGAAATAATATATGAATTGCTTGAAGAATCACAAAACCA
GCAGGAAAAGAATGAACAAGATTTACTAGCATTGGACAGATGGAACAGTCTGTGGAATTGGTTTAACATAACAAATT
GGCTGTGGTATATAAAAATATTCATAATGATAGTAGGAGGCTTGATAGGTTTAAGAATAATTTTTGCTGTGCTTTCT
TTAGTAAATAGAGTTAGGCAGGGATACTCACCTCTGTCGTTGCAGACCCTTATCCCAAGCCCGAGGGGACCAGACAG
GCCCGGAGGAATCGAAGAAGAAGGTGGAGAGCAAGACAGAAACAGATCAACGCGATTAGTGAGCGGATTCTTAGCGC
TTGTCTGGGACGACCTGCGGAGCCTGTGCCTTTTCATCTACCACCGATTGAGAGACTTCATATTAATTGCAGCGAGA
GCGGGGGAACTTCTGGGACGCAGCAGTCTCAAGGGACTACGGAGAGGATGGGAAGCCCTTAAGTATCTGGGAAGTCT
TGTGCAGTATTGGGGCCTGGAACTAAAAAGGAGTGCTATTAGTCTATTGGATACCCTAGCAATAGCAGTAGGTGAAG
GAACAGATAGGATTCTAGAATTTGTATTAGGAATTTGTAGAGCTATCCGCAACATACCTACAAGAATAAGACAGGGC
TTTGAAACAGCTTTGCTATAA
>703010505.W22.6
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATGCTACTGCCAGCAATACCAATGCTACTGCCAGCAATAGCAGTATAATAGAGGGAATGAAAAATTGCTCTTTCAATATAACC
ACAGAATTAAGAGATAAGAGAGAGAAAAAGAATGCACTTTTTTATAAACTTGATATAGTACAACTAGATGGCAACTC
TAGTCAGTATAGATTAATAAATTGTAATACCTCAGTCATAACACAAGCCTGTCCAAAGGTCTCTTTTGACCCCAATTC
CTATACATTATTGTGCTCCAGCTGGTTATGCGATTCTAAAGTGTAATAATAAGACATTCACTGGAACAGGACCGTGT
AATAATGTCAGCACAGTACAATGTACACATGGAATTAAGCCAGTGGTTTCAACTCAACTATTGTTAAATGGTAGCCT
AGCAGAAGGAGAGATAATAATTAGATCTGAAAATATAACAAACAATGCCAAAACAATAATAGTACATCTCAATGAAT

FIG. 17B cont'd

```
CTGTAAAGATTGAGTGTACGAGACCCAATAATAAAACAAGAACAAGTATAAGAATAGGACCAGGACAAGCATTTTAT
GCAACAGGACAAGTAATAGGAGACATAAGAGAAGCACATTGTAACATTAGTGAAAGTAAATGGAATGAAACTTTACA
AAGGGTAAGTAAAAAATTAAAAGAATACTTCCCTCATAAGAATATAACATTTCAACCATCCTCAGGAGGGGACCTAG
AAATTACAACACATAGCTTTAATTGTGGAGGAGAATTTTTCTATTGCAATACATCAAGCCTGTTTAATAGGACATAT
ATGGCTAATAGTACAGATATGGCTAATAGTACAGAAACTAACAGTACACGAATCATCACAATCCACTGCAGAATAAA
ACAAATTATAAACATGTGGCAGGAGGTGGGACGAGCAATGTATGCCCCTCCCATTGCAGGAAACATAACATGTATAT
CAAATATCACAGGACTACTATTGACAAGGGATGGAGGAAAAAACAATACGGAGACATTCAGACCTGGAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGTTGGAGTAATAAAACTTATGGTGATATTTGGGATAACATGACCTGG
ATGCAGTGGGAGAGAGAAATTAGCAATTATACAGAAATAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCGTTACAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGTCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGATGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAAGGAACAG
ATAGGATTCTAGAATTTGTATTAGGAATTTGTAGAGCTATCCGCAACATACCTACAAGAATAAGACAGGGCTTTGAA
ACAGCTTTGCTATAA
>703010505.W22.7
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATGCTACTGCCAGCAATAGCAGTATAATAGAGGGAATGAAAAATTGCTCTTTCAATATAACC
ACAGAATTAAGAGATAAGAGAGAGAAAAAAGAATGCACTTTTTTATAAACTTGATATAGTACAACTAGATGGCAACTC
TAGTCAGTATAGATTAATAAATTGTAATACCTCAGTCATAACACAAGCCTGTCCAAAGGTCTCTTTTGACCCAATTC
CTATACATTATTGTGCTCCAGCTGGTTATGCGATTCTAAAGTGTAATAATAAGACATTCACTGGAACAGGACCGTGT
AATAATGTCAGCACAGTACAATGTACACATGGAATTAAGCCAGTGGTTTCAACTCAACTATTGTTAAATGGTAGCCT
AGCAGAAGGAGAGATAATAATTAGATCTGAAAATATAACAAACAATGCCAAAACAATAATAGTACATCTCAATGAAT
CTGTAAAGATTGAGTGTACGAGACCCAATAATAAAACAAGAACAAGTATAAGAATAGGACCAGGACAAGCATTTTAT
GCAACAGGACAAGTAATAGGAGACATAAGAGAAGCACATTGTAACATTAGTGAAAGTAAATGGAATGAAACTTTACA
AAGGGTAAGTAAAAAATTAAAAGAATACTTCCCTCATAAGAATATAACATTTCAACCATCCTCAGGAGGGGACCTAG
AAATTACAACACATAGCTTTAATTGTGGAGGAGAATTTTTCTATTGCAATACATCAAGCCTGTTTAATAGGACATAT
ATGGCTAATAGTACAGATATGGCTAATAGTACAGAAACTAACAGTACACGAATCATCACAATCCACTGCAGAATAAA
ACAAATTATAAACATGTGGCAGGAGGTGGGACGAGCAATGTATGCCCCTCCCATTGCAGGAAACATAACATGTATAT
CAAATATCACAGGACTACTATTGACAAGGGATGGAGGAAAAAACAATACGGAGACATTCAGACCTGGAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGTTGGAGTAATAAAACTTATGGTGATATTTGGGATAACATGACCTGG
ATGCAGTGGGAGAGAGAAATTAGCAATTATACAGAAATAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCGTTACAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGTCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGATGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAAGGAACAG
ATAGGATTCTAGAATTTGTATTAGGAATTTGTAGAGCTATCCGCAACATACCTACAAGAATAAGACAGGGCTTTGAA
ACAGCTTTGCTATAA
>703010505.W22.10
ATGAGAGTGATGGGGATACAGAGGAATTATCCACAATGGTGGATATGGAGCATGTTAGGATTTTGGATGCTAATGAT
TTGTAACGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
CGTAATTAGTTTATGGGATCAAAGCCTCAAGCCATGTGTAAAGTTGACCCCACTCTGTGTCACTCTAAACTGTACCA
ATGCTACTAATGCTACTGCCAGCAATAGCAGTATAATAGAGGGAATGAAAAATTGCTCTTTCAATATAACCACAGAA
TTAAGAGATAAGAGAGAGAAAAAGAATGCACTTTTTTTATAAACTTGATATAGTACAACTAGATGGCAACTCTAGTC
AGTATAGATTAATAAATTGTAATACCTCAGTCATAACACAAGCCTGTCCAAAGGTCTCTTTTGACCCAATACCTATA
CATTATTGTGCTCCAGCTGGTTATGCGATTCTAAAGTGTAATAATAAGACATTCACTGGAACAGGACCGTGTAATAA
TGTCAGCACAGTACAATGTACACATGGAATTAAGCCAGTGGTTTCAACTCAACTATTGTTAAATGGTAGCCTAGCAG
AAGGAGAGATAATAATTAGATCTGAAAATATAACAAACAATGGCAAAACAATAATAGTACATCTCAATGAATCTGTA
```

FIG. 17B cont'd

AAGATTGAGTGTACGAGACCCAATAATAAAACAAGAACAAGTATAAGAATAGGACCAGGACAAGCATTTTATGCAAC
AGGACAAGTAATAGGAGACATAAGAGAAGCATATTGTAACATTAGTGAAAGTAAATGGAATGAAACTTTACAAAGGG
TAAGTAAAAAATTAAAAGAATACTTCCCTCATAAGAATATAACATTTCAACCATCCTCAGGAGGGGACCTAGAAATT
ACAACACATAGCTTTAATTGTGGAGGAGAATTTTTCTATTGCAATACATCAAGCCTGTTTAATAGGACATATATGGC
TAATAGTACAGATATGGCTAATAGTACAGAAACTAACAGTACAGAATCATCACAATCCACTGCAGAATAAAACAAA
TTATAAACATGTGGCAGGAGGTGGGACGAGCAATGTATGCCCCTCCCATTGCAGGAAACATAACATGTATATCAAAT
ATCACAGGACTACTATTGACAAGGGATGGAGGAAAAAACAATACGGAGACATTCAGACCTGGAGGAGGAAATATGAA
GGACAATTGGAGAAGTGAATTATATAAATATAAAGTGGTAGAAGTTAAGCCATTAGGAGTAGCACCCACTAATGCAA
GAAGGAGAGTGGTGGAGAGAGAAAAAGAGCAGTGGGAATGGGAGCTGTGTTCCTTGGGTTCTTGGGAGCGGCAGGA
AGCACTATGGGCGCAGCATCAATAACGCTGACGGTACAGGCCAGACAATTATTGTCTGGTATAGTGCAACAGCAAAG
CAATTTGCTGAAGGCTATAGAGGCTCAACAGCATATGTTGAAACTCACGGTCTGGGGCATTAAACAGCTCCAGGCAA
GAGTCCTGGCCTTGGAAAGATACCTAAAGGATCAACAGCTCCTAGGGATGTGGGGCTGCTCTGGAAAACTCATCTGC
ACCACTAATGTATATTGGAACTCTAGTTGGAGTAATAAAACTTATGGTGATATTTGGGATAACATGACCTGGATGCA
GTGGGAGAGAGAAATTAGCAATTATACAGAAATAATATATGAATTGCTTGAAGAATCACAAAACCAGCAGGAAAAGA
ATGAACAAGATTTACTAGCATTGGACAGATGGAACAGTCTGTGGAATTGGTTTAACATAACAAATTGGCTGTGGTAT
ATAAAAATATTCATAATGATAGTAGGAGGCTTGATAGGTTTAAGAATAATTTTTGCTGTGCTTTCTTTAGTAAATAG
AGTTAGGCAGGGATACTCACCTCTGTCGTTGCAGACCCTTATCCCAAGCCCGAGGGGGCCAGACAGGCCCGGAGGAA
TCGAAGAAGAAGGTGGAGAGCAAGACAGAAACAGATCAACGCGATTAGTGAGCGGATTCTTAGCGCTTGTCTGGGAC
GACCTGCGGAGCCTGTGCCTTTTCATCTACCACCGATTGAGAGACTTCATATTAATTGCAGCGAGAGCGGGGAACT
TCTGGGACGCAGCAGTCTCAAGGGACTACGGAGAGGATGGGAAGCCCTTAAGTATCTGGGAAGTCTTGTGCAGTATT
GGGGCCTGGAACTAAAAAGGAGTGCTATTAGTCTATTGGATACCCTAGCAATAGCAGTAGGTGAAGGAACAGATAGG
ATTCTAGAATTTGTATTAGGAATTTGTAGAGCTATCCGCAACATACCTACAAGAATAAGACAGGGCTTTGAAACAGC
TTTGCTATAA
>703010505.W22.11
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTAATGCTACTGCCAGCAATAGCAGTATAATAGAGGGAATGAAAAATTGCTCTTTCAATATAACCACAGAA
TTAAGAGATAAGAGAGAGAAAAAGAATGCACTTTTTTATAAACTTGATATAGTACAACTAGATGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCACTGGAACAGGATCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTGAAAATATAACAAACAATGGCAAAACAATAATAGTACATCTCAATGAATCTGTAA
AGATTGAGTGTACGAGACCCAATAATAAAACAAGAACAAGTATAAGAATAGGACCAGGACAAGCATTTTATGCAACA
GGACAAGTAATAGGAGACATAAGAGAAGCATATTGTAACATTAGTGAAAGTAAATGGAATGAAACTTTACAAAGGGT
AAGTAAAAAATTAAAAGAATACTTCCCTCATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
AATAGTACAGATATGGCTAATAGTACAGAAACTAACAGTACACGAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAAAAACAATACGGAGACATTCAGACCTGGAGGAGGAAATATGAAG
GACAATTGGAGAAGTGAATTATATAAATATAAAGTGGTAGAAGTTAAGCCATTAGGAGTAGCACCCACTAATGCAAG
AAGGAGAGTGGTGGAGAGAGAAAAAGAGCAGTGGGAATGGGAGCTGTGTTCCTTGGGTTCTTGGGAGCGGCAGGAA
GCACTATGGGCGCAGCATCAATAACGCTGACGGTACAGGCCAGACAATTATTGTCTGGTATAGTGCAACAGCAAAGC
AATTTGCTGAAGGCTATAGAGGCTCAACAGCATATGTTGAAACTCACGGTCTGGGGCATTAAACAGCTCCAGGCAAG
AGTCCTGGCCTTGGAAAGATACCTAAAGGATCAACAGCTCCTAGGGATGTGGGGCTGCTCTGGAAAACTCATCTGCA
CCACTAATGTATATTGGAACTCTAGTTGGAGTAATAAAACTTATGGTGATATTTGGGATAACATGACCTGGATGCAG
TGGGAGAGAGAAATTAGCAATTATACAGAAATAATATATGAATTGCTTGAAGAATCACAAAACCAGCAGGAAAAGAA
TGAACAAGATTTACTAGCATTGGACAGATGGAACAGTCTGTGGAATTGGTTTAACATAACAAATTGGCTGTGGTATA
TAAAAATATTCATAATGATAGTAGGAGGCTTGATAGGTTTAAGAATAATTTTTGCTGTGCTTTCTTTAGTAAATAGA
GTTAGGCAGGGATACTCACCTCTGTCGTTGCAGACCCTTATCCCAAGCCCGAGGGGGCCAGACAGGCCCGGAGGAAT
CGAAGAAGAAGGTGGAGAGCAAGACAGAAACAGATCAACGCGATTAGTGAGCGGATTCTTAGCGCTTGTCTGGGACG
ACCTGCGGAGCCTGTGCCTTTTCATCTACCACCGATTGAGAGACTTCATATTAATTGCAGCGAGAGCGGGGAACTT
CTGGGACGCAGCAGTCTCAAGGGACTACGGAGAGGATGGGAAGCCCTTAAGTATCTGGGAAGTCTTGTGCAGTATTG
GGGCCTGGAACTAAAAGGAGTGCTATTAGTCTATTGGATACCCTAGCAATAGCAGTAGGTGAAGGAACAGATAGGA
TTCTAGAATTTGTATTAGGAATTTGTAGAACTATCCGCAACATACCTACAAGAATAAGACAGGGCTTTGAAACAGCT
TTGCTATAA
>703010505.W22.13
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTAATGCTACTGCCAGCAATAGCAGTATAATAGAGGGAATGAAAAATTGCTCTTTCAATATAACCACAGAA
TTAAGAGATAAGAGAGAGAAAAAGAATGCACTTTTTTATAAACTTGATATAGTACAACTAGATGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCACTGGAACAGGATCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTGAAAATATAACAAACAATGGCAAAACAATAATAGTACATCTCAATGAATCTGTAA

FIG. 17B cont'd

```
AGATTGAGTGTACGAGACCCAATAATAAAACAAGAACAAGTATAAGAATAGGACCAGGACAAGCATTTTATGCAACA
GGACAAGTAATAGGAGACATAAGAGAAGCATATTGTAACATTAGTGAAAGTAAATGGAATGAAACTTTACAAAGGGT
AAGTAAAAAATTAAAAGAATACTTCCCTCATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
AATAGTACAGATATGGCTAATAGTACAGAAACTAACAGTACACGAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAAAAACAATACGGAGACATTCAGACCTGGAGGAGGAAATATGAAG
GACAATTGGAGAAGTGAATTATATAAATATAAAGTGGTAGAAGTTAAGCCATTAGGAGTAGCACCCACTAATGCAAG
AAGGAGAGTGGTGGAGAGAGAAAAAAGAGCAGTGGGAATGGGAGCTGTGTTCCTTGGGTTCTTGGGAGCGGCAGGAA
GCACTATGGGCGCAGCATCAATAACGCTGACGGTACAGGCCAGACAATTATTGTCTGGTATAGTGCAACAGCAAAGC
AATTTGCTGAAGGCTATAGAGGCTCAACAGCATATGTTGAAACTCACGGTCTGGGGCATTAAACAGCTCCAGGCAAG
AGTCCTGGCCTTGGAAAGATACCTAAAGGATCAACAGCTCCTAGGGATGTGGGGCTGCTCTGGAAAACTCATCTGCA
CCACTAATGTATATTGGAACTCTAGTTGGAGTAATAAAACTTATGGTGATATTTGGGATAACATGACCTGGATGCAG
TGGGAGAGAGAAATTAGCAATTATACAGAAATAATATATGAATTGCTTGAAGAATCACAAAACCAGCAGGAAAAGAA
TGAACAAGATTTACTAGCATTGGACAGATGGAACAGTCTGTGGAATTGGTTTAACATAACAAATTGGCTGTGGTATA
TAAAAATATTCATAATGATAGTAGGAGGCTTGATAGGTTTAAGAATAATTTTTGCTGTGCTTTCTTTAGTAAATAGA
GTTAGGCAGGGATACTCACCTCTGTCGTTGCAGACCCTTATCCCAAGCCCGAGGGGACCAGACAGGCCCGGAGGAAT
CGAAGAAGAAGGTGGAGAGCAAGACAGAAACAGATCAACGCGATTAGTGAGCGGATTCTTAGCGCTTGTCTGGGACG
ACCTGCGGAGCCTGTGCCTTTTCATCTACCACCGATTGAGAGACTTCATATTAATTGCAGCGAGAGCGGGGAACTT
CTGGGACGCAGCAGTCTCAAGGGACTACGGAGAGGATGGGAAGCCCTTAAGTATCTGGGAAGTCTTGTGCAGTATTG
GGGCCTGGAACTAAAAAGGAGTGCTATTAGTCTATTGGATACCCTAGCAATAGCAGTAGGTGAAGGAACAGATAGGA
TTCTAGAATTTGTATTAGGAATTTGTAGAGCTATCCGCAACATACCTACAAGAATAAGACAGGGCTTTGAAACAGCT
TTGCTATAA
>703010505.W22.16
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTAATGCTACTGCCAGCAATAGCAGTATAATAGAGGGAATGAAAAATTGCTCTTTCAATATAACCACAGAA
TTAAGAGATAAGAGAGAGAAAAAGAATGCACTTTTTTATAAACTTGATATAGTACAACTAGATGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCACTGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTGAAAATATAACAAACAATGGCAAAACAATAATAGTACATCTCAATGAATCTGTAA
AGATTGAGTGTACGAGACCCAATAATAAAACAAGAACAAGTATAAGAATAGGACCAGGACAAGCATTTTATGCAACA
GGACAAGTAATAGGAGACATAAGAGAAGCATATTGTAACATTAGTGAAAGTAAATGGAATGAAACTTTACAAAGGGT
AAGTAAAAAATTAAAAGAATACTTCCCTCATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
AATAGTACAGATATGGCTAATAGTACAGAAACTAACAGTACACGAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAAAAACAATACGGAGACATTCAGACCTGGAGGAGGAAATATGAAG
GACAATTGGAGAAGTGAATTATATAAATATAAAGTGGTAGAAGTTAAGCCATTAGGAGTAGCACCCACTAATGCAAG
AAGGAGAGTGGTGGAGAGAGAAAAAAGAGCAGTGGGAATGGGAGCTGTGTTCCTTGGGTTCTTGGGAGCGGCAGGAA
GCACTATGGGCGCAGCATCAATAACGCTGACGGTACAGGCCAGACAATTATTGTCTGGTATAGTGCAACAGCAAAGC
AATTTGCTGAAGGCTATAGAGGCTCAACAGCATATGTTGAAACTCACGGTCTGGGGCATTAAACAGCTCCAGGCAAG
AGTCCTGGCCTTGGAAAGATACCTAAAGGATCAACAGCTCCTAGGGATGTGGGGCTGCTCTGGAAAACTCATCTGCA
CCACTAATGTATATTGGAACTCTAGTTGGAGTAATAAAACTTATGGTGATATTTGGGATAACATGACCTGGATGCAG
TGGGAGAGAGAAATTAGCAATTATACAGAAATAATATATGAATTGCTTGAAGAATCACAAAACCAGCAGGAAAAGAA
TGAACAAGATTTACTAGCATTGGACAGATGGAACAGTCTGTGGAATTGGTTTAACATAACAAATTGGCTGTGGTATA
TAAAAATATTCATAATGATAGTAGGAGGCTTGATAGGTTTAAGAATAATTTTTGCTGTGCTTTCTTTAGTAAATAGA
GTTAGGCAGGGATACTCACCTCTGTCGTTGCAGACCCTTATCCCAAGCCCGAGGGGACCAGACAGGCCCGGAGGAAT
CGAAGAAGAAGGTGGAGAGCAAGACAGAAACAGATCAACGCGATTAGTGAGCGGATTCTTAGCGCTTGTCTGGGACG
ACCTGCGGAGCCTGTGCCTTTTCATCTACCACCGATTGAGAGACTTCATATTAATTGCAGCGAGAGCGGGGAACTT
CTGGGACGCAGCAGTCTCAAGGGACTACGGAGAGGATGGGAAGCCCTTAAGTATCTGGGAAGTCTTGTGCAGTATTG
GGGCCTGGAACTAAAAAGGAGTGCTATTAGTCTATTGGATACCCTAGCAATAGCAGTAGGTGAAGGAACAGATAGGA
TTCTAGAATTTGTATTAGGAATTTGTAGAGCTATCCGCAACATACCTACAAGAATAAGACAGGGCTTTGAAACAGCT
TTGCTATAA
>703010505.W22.17
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTACCAATGCTACTGCCAGCAATAGCAGTATAATAGAGGGAATGAAAAATTGCTCTTTCAATATAACCACA
GAATTAAGAGATAAGAGAGAGAAAAAGAATGCACTTTTTTATAAACTTGATATAGTACAACTAGATGGCAACTCTAG
TCAGTATAGATTAATAAATTGTAATACCTCAGTCATAACACAAGCCTGTCCAAAGGTCTCTTTTGACCCAATTCCTA
TACATTATTGTGCTCCAGCTGGTTATGCGATTCTAAAGTGTAATAATAAGACATTCACTGGAACAGGACCGTGTAAT
AATGTCAGCACAGTACAATGTACACATGGAATTAAGCCAGTGGTTTCAACTCAACTATTGTTAAATGGTAGCCTAGC
AGAAGGAGAGATAATAATTAGATCTGAAAATATAACAAACAATGGCAAAACAATAATAGTACATCTCAATGAACCTG
```

FIG. 17B cont'd

```
TAAAGATTGAGTGTACGAGACCCAATAATAAAACAAGAACAAGTATAAGAATAGGACCAGGACAAGCATTTTATGCA
ACAGGACAAGTAATAGGAGACATAAGAGAAGCATATTGTAACATTAGTGAAAGTAAATGGAATGAAACTTTACAAAG
GGTAAGTAAAAAATTAAAAGAATACTTCCCTCATAAGAATATAACATTTCAACCATCCTCAGGAGGGGACCTAGAAA
TTACAACACATAGCTTTAATTGTGGAGGAGAATTTTTCTATTGCAATACATCAAGCCTGTTTAATAGGACATATATG
GCTAATAGTACAGATATGGCTAATAGTACAGAAACTAACAGTACACGAATCATCACAATCCACTGCAGAATAAAACA
AATTATAAACATGTGGCAGGAGGTGGGACGAGCAATGTATGCCCCTCCCATTGCAGGAAACATAACATGTATATCAA
ATATCACAGGACTACTATTGACAAGGGATGGAGGAAAAAACAATACGGAGACATTCAGACCTGGAGGAGGAAATATG
AAGGACAATTGGAGAAGTGAATTATATAAATATAAAGTGGTAGAAGTTAAGCCATTAGGAGTAGCACCCACTAATGC
AAGAAGGAGAGTGGTGGAGAGAGAAAAAAGAGCAGTGGGAATGGGAGCTGTGTTCCTTGGGTTCTTGGGAGCGGCAG
GAAGCACTATGGGCGCAGCATCAATAACGCTGACGGTACAGGCCAGACAATTATTGTCTGGTATAGTGCAACAGCAA
AGCAATTTGCTGAAGGCTATAGAGGCTCAACAGCATATGTTGAAACTCACGGTCTGGGGCATTAAACAGCTCCAGGC
AAGAGTCCTGGCCTTGGAAAGATACCTAAAGGATCAACAGCTCCTAGGGATGTGGGGCTGCTCTGGAAAACTCATCT
GCACCACTAATGTATATTGGAACTCTAGTTGGAGTAATAAAACTTATGGTGATATTTGGGATAACATGACCTGGATG
CAGTGGGAGAGAGAAATTAGCAATTATACAGAAATAATATATGAATTGCTTGAAGAATCACAAAACCAGCAGGAAAA
GAATGAACAAGATTTACTAGCATTGGACAGATGGAACAGTCTGTGGAATTGGTTTAACATAACAAATTGGCTGTGGT
ATATAAAAATATTCATAATGATAGTAGGAGGCTTGATAGGTTTAAGAATAATTTTTGCTGTGCTTTCTTTAGTAAAT
AGAGTTAGGCAGGGATACTCACCTCTGTCGTTGCAGACCCTTATCCCAAGCCCGAGGGGACCAGACAGGCCCGGAGG
AATCGAAGAAGAAGGTGGAGAGCAAGACAGAAACAGATCAACGCGATTAGTGAGCGGATTCTTAGCGCTTGTCTGGG
ACGACCTGCGGAGCCTGTGCCTTTTCATCTACCACCGATTGAGAGACTTCATATTAATTGCAGCGAGAGCGGGGGAA
CTTCTGGGACGCAGCAGTCTCAAGGGACTACGGAGAGGATGGGAAGCCCTTAAGTATCTGGGAAGTCTTGTGCAGTA
TTGGGGCCTGGAACTAAAAAGGAGTGCTATTAGTCTATTGGATACCCTAGCAATAGTAGTAGGTGAAGGAACAGATA
GGATTCTAGAATTTGTATTAGGAATTTGTAGAGCTATCCGCAACATACCTACAAGAATAAGACAGGGCTTTGAAACA
GCTTTGCTATAA
>703010506.W22.18
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTACCAATGCTACTGCCAGCAATAGCAGTATAATAGAGGGAATGAAAAATTGCTCTTTCAATGTAACCACA
GAATTAAGAGATAAGAGAGAGAAAAAGAATGCACTTTTTTATAAACTTGATATAGTACAACTAGATGGCAACTCTAG
TCAGTATAGATTAATAAATTGTAATACCTCAGTCATAACACAAGCCTGTCCAAAGGTCTCTTTTTGACCCAATTCCTA
TACATTATTGTGCTCCAGCTGGTTATGCGATTCTAAAGTGTAATAATAAGACATTCACTGGAACAGGACCGTGTAAT
AATGTCAGCACAGTACAATGTACACATGGAATTAAGCCAGTGGTTTCAACTCAACTATTGTTAAATGGTAGCCTAGC
AGAAGGAGAGATAATAATTAGATCTGAAAATATAACAAACAATGGCAAAACAATAATAGTACATCTCAATGAATCTG
TAAAGATTGAGTGTACGAGACCCAATAATAAAACAAGAACAAGTATAAGAATAGGACCAGGACAAGCATTTATGCA
ACAGGACAAGTAATAGGAGACATAAGAGAAGCTATTGTAACATTAGTGAAAGTAAATGGAATGAAACTTTACAAAG
GGTAAGTAAAAAATTAAAAGAATACTTCCCTCATAAGAATATAACATTTCAACCATCCTCAGGAGGGGACCTAGAAA
TTACAACACATAGCTTTAATTGTGGAGGAGAATTTTTCTATTGCAATACATCAAGCCTGTTTAATAGGACATATATG
GCTAATAGTACAGATATGGCTAATAGTACAGAAACTAACAGTACACGAACCATCACAATCCGCTGCAGAATAAAACA
AATTATAAACATGTGGCAGGAGGTGGGACGAGCAATGTATGCCCCTCCCATTGCAGGAAACATAACATGTATATCAA
ATATCACAGGACTACTATTGACAAGGGATGGAGGAAAAAACAATACGGAGACATTCAGACCTGGAGGAGGAAATATG
AAGGACAATTGGAGAAGTGAATTATATAAATATAAAGTGGTAGAAGTTAAGCCATTAGGAGTAGCACCCACTAATGC
AAGAAGGAGAGTGGTGGAGAGAGAAAAAAGAGCAGTGGGAATGGGAGCTGTGTTCCTTGGGTTCTTGGGAGCGGCAG
GAAGCACTATGGGCGCAGCATCAATAACGCTGACGGTACAGGCCAGACAATTATTGTCTGGTATAGTGCAACAGCAA
AGCAATTTGCTGAAGGCTATAGAGGCTCAACAGCATATGTTGAAACTCACGGTCTGGGGCATTAAACAGCTCCAGGC
AAGAGTCCTGGCCTTGGAAAGATACCTAAAGGATCAACAGCTCCTAGGGATGTGGGGCTGCTCTGGAAAACTCATCT
GCACCACTAATGTATATTGGAACTCTAGTTGGAGTAATAAAACTTATGGTGATATTTGGGATAACATGACCTGGATG
CAGTGGGAGAGAGAAATTAGCAATTATACAGAAATAATATATGAATTGCTTGAAGAATCACAAAACCAGCAGGAAAA
GAATGAACAAGATTTACTAGCATTGGACAGATGGAACAGTCTGTGGAATTGGTTTAACATAACAAATTGGCTGTGGT
ATATAAAAATATTCATAATGATAGTAGGAGGCTTGATAGGTTTAAGAATAATTTTTGCTGTGCTTTCTTTAGTAAAT
AGAGTTAGGCAGGGATACTCACCTCTGTCGTTGCAGACCCTTATCCCAAGCCCGAGGGGACCAGACAGGCCCGGAGG
AATCGAAGAAGAAGGTGGAGAGCAAGACAGAAACAGATCAACGCGATTAGTGAGCGGATTCTTAGCGCTTGTCTGGG
ACGACCTGCGGAGCCTGTGCCTTTTCATCTACCACCGATTGAGAGACTTCATATTAATTGCAGCGAGAGCGGGGGAA
CTTCTGGGACGCAGCAGTCTCAAGGGACTACGGAGAGGATGGGAAGCCCTTAAGTATCTGGGAAGTCTTGTGCAGTA
TTGGGGCCTGGAACTAAAAAGGAGTGCTATTAGTCTATTGGATACCCTAGCAATAGCAGTAGGTGAAGGAACAGATA
GGATTCTAGAATTTGTATTAGGAATTTGTAGAGCTATCCGCAACATACCTACAAGAATAAGACAGGGCTTTGAAACA
GCTTTGCTATAA
>703010506.W22.1
ATGAGAGTGATGGGGATACAGAGGAATCATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTACCAATGCTACTGCCAGCAATAGCAGTATAATAGAGGGAATGAAAAATTGCTCTTTCAATATAACCACA
GAATTAAGAGATAAGAGAGAGAAAAAGAATGCACTTTTTTATAAACTTGATATAGTACAACTAGATGGCAACTCTAG
TCAGTATAGATTAATAAATTGTAATACCTCAGTCATAACACAAGCCTGTCCAAAGGTCTCTTTTGACCCAATTCCTA
TACATTATTGTGCTCCAGCTGGTTATGCGATTCTAAAGTGTAATAATAAGACATTCACTGGAACAGGACCGTGTAAT
AATGTCAGCACAGTACAATGTACACATGGAATTAAGCCAGTGGTTTCAACTCAACTATTGTTAAATGGTAGCCTAGC
AGAAGGAGAGATAATAATTAGATCTGAAAATATAACAAACAATGCCAAAACAATAATAGTACATCTCAATGAATCTG
```

FIG. 17B cont'd

TAAAGATTGAGTGTACGAGACCCAATAATAAAACAAGAACAAGTATAAGAATAGGACCAGGACAAGCATTTTATGCA
ACAGGACAAGTAATAGGAGACATAAGAGAAGCATATTGTAACATTAGTGAAAGTAAATGGAATGAAACTTTACAAAG
GGTAAGTAAAAAATTAAAAGAATACTTCCCTCATAAGAATATAACATTTCAACCATCCTCAGGAGGGGACCTAGAAA
TTACAACACATAGCTTTAATTGTGGAGGAGAATTTTTCTATTGCAATACATCAAGCCTGTTTAATAGGACATATATG
GCTAATAGTACAGATATGGCTAATAGTACAGAAACTAACAGTACACGAACCATCACAATCCGCTGCAGAATAAAACA
AATTATAAACATGTGGCAGGAGGTGGGACGGGCAATGTATGCCCCTCCCATTGCAGGAAACATAACATGTATATCAA
ATATCACAGGACTACTATTGACAAGGGATGGAGGAAAAACCAATACGGAGACATTCAGACCTGGAGGAGGAAATATG
AAGGACAATTGGAGAAGTGAATTATATAAATATAAAGTGGTAGAAGTTAAGCCATTAGGAGTAGCACCCACTAATGC
AAGAAGGAGAGTGGTGGAGAGAGAAAAAAGAGCAGTGGGAATGGGAGCTGTGTTCCTTGGGTTCTTGGGAGCGGCAG
GAAGCACTATGGGCGCAGCATCAATAACGCTGACGGTACAGGCCAGACAATTATTGTCTGGTATAGTGCAACAGCAA
AGCAATTTGCTGAAGGCTATAGAGGCTCAACAGCATATGTTGAAACTCACGGTCTGGGGCATTAAACAGCTCCAGGC
AAGAGTCCTGGCCTTGGAAAGATACCTAAAGGATCAACAGCTCCTAGGGATGTGGGGCTGCTCTGGAAAACTCATCT
GCACCACTAATGTATATTGGAACTCTAGTTGGAGTAATAAAACTTATGGTGATATTTGGGATAACATGACCTGGATG
CAGTGGGAGAGAGAAATTAGCAATTATACAGAATAATATATGAATTGCTTGAAGAATCACAAAACCAGCAGGAAAA
GAATGAACAAGATTTACTAGCATTGGACAGATGGAACAGTCTGTGTGGAATTGGTTTAACATAACAAATTGGCTGTGGT
ATATAAAAATATTCATAATGATAGTAGGAGGCTTGATAGGTTTAAGAATAATTTTTGCTGTGCTTTCTTTAGTAAAT
AGAGTTAGGCAGGGATACTCACCTCTGTCGTTGCAGACCCTTATCCCAAGCCCGAGGGGACCAGACAGGCCCGGAGG
AATCGAAGAAGAAGGTGGAGAGCAAGACAGAAACAGATCAACGCGATTAGTGAGCGGATTCTTAGCGCTTGTCTGGG
ACGACCTGCGGAGCCTGTGCCTTTTCATCTACCACCGATTGAGAGACTTCATATTAATTGCAGCGAGAGCGGGGAA
CTTCTGGGACGCAGCAGTCTCAAGGGACTACGGAGAGGATGGGAAGCCCTTAAGTATCTGGGAAGTCTTGTGCAGTA
TTGGGGCCTGGAACTAAAAAGGAGTGCTATTAGTCTATTGGATACCCTAGCAATAACAGTAGGTGAAGGAACAGATA
GGATTCTAGAATTTGTATTAGGAATTTGTAGAGCTATCCGCAACATACCTACAAGAATAAGACAGGGCTTTGAAACA
GCTTTGCTATAA
>703010505.W22.5
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
CGTAATTAGTTTATGGGATCAAAGCCTCAAGCCATGTGTAAAGTTGACCCCACTCTGTGTCACTCTAAACTGTACCA
ATGCTACTACCAATGCTACTGCCAGCAATAGCAGTATAATAGAGGGAATGAAAAATTGCTCTTTCAATATAACCACA
GAATTAAGAGATAAGAGAGAGAAAAAGAATGCACTTTTTTATAAACTTGATATAGTACAACTAGATGGCAACTCTAG
TCAGTATAGATTAATAAATTGTAATACCTCAGTCATAACACAAGCCTGTCCAAAGGTCTCTTTTGACCCAATTCCTA
TACATTATTGTGCTCCAGCTGGTTATGCGATTCTAAAGTGTAATAATAAGACATTCACTGGAACAGGACCGTGTAAT
AATGTCAGCACAGTACAATGTACACATGGAATTAAGCCAGTGGTTTCAACTCAACTATTGTTAAATGGTAGCCTAGC
AGAAGGAGAGATAATAATTAGATCTGAAAATATAACAAACAATGCCAAAACAATAATAGTACATCTCAATGAATCTG
TAAAGATTGAGTGTACGAGACCCAGTAATAAAACAAGAACAAGTATAAGAATAGGACCAGGACAAGCATTTTATGCA
ACAGGACAAGTAATAGGAGACATAAGAGAAGCATATTGTAACATTAGTGAAAGTAAATGGAATGAAACTTTACAAAG
GGTAAGTAAAAAATTAAAAGAATACTTCCCTCATAAGAATATAACATTTCAACCATCCTCAGGAGGGGACCTAGAAA
TTACAACACATAGCTTTAATTGTGGAGGAGAATTTTTCTATTGCAATACATCAAGCCTGTTTAATAGGACATATATG
GCTAATAGTACAGATATGGCTAATAGTACAGAAACTAACAGTACACGAACCATCACAATCCGCTGCAGAATAAAACA
AATTATAAACATGTGGCAGGAGGTGGGACGAGCAATGTATGCCCCTCCCATTGCAGGAAACATAACATGTATATCAA
ATATCACAGGACTACTATTGACAAGGGATGGAGGAAAAACCAATACGGAGACATTCAGACCTGGAGGAGGAAATATG
AAGGACAATTGGAGAAGTGAATTATATAAATATAAAGTGGTAGAAGTTAAGCCATTAGGAGTAGCACCCACTAATGC
AAGAAGGAGAGTGGTGGAGAGAGAAAAAAGAGCAGTGGGAATGGGAGCTGTGTTCCTTGGGTTCTTGGGAGCGGCAG
GAAGCACTATGGGCGCAGCATCAATAACGCTGACGGTACAGGCCAGACAATTATTGTCTGGTATAGTGCAACAGCAA
AGCAATTTGCTGAAGGCTATAGAGGCTCAACAGCATATGTTGAAACTCACGGTCTGGGGCATTAAACAGCTCCAGGC
AAGAGTCCTGGCCTTGGAAAGATACCTAAAGGATCAACAGCTCCTAGGGATGTGGGGCTGCTCTGGAAAACTCATCT
GCACCACTAATGTATATTGGAACTCTAGTTGGAGTAATAAAACTTATGGTGATATTTGGGATAACATGACCTGGATG
CAGTGGGAGAGAGAAATTAGCAATTATACAGAATAATATATGAATTGCTTGAAGAATCACAAAACCAGCAGGAAAA
GAATGAACAAGATTTACTAGCATTGGACAGATGGAACAGTCTGTGGAATTGGTTTAACATAACAAATTGGCTGTGGT
ATATAAAAATATTCATAATGATAGTAGGAGGCTTGATAGGTTTAAGAATAATTTTTGCTGTGCTTTCTTTAGTAAAT
AGAGTTAGGCAGGGATACTCACCTCTGTCGTTGCAGACCCTTATCCCAAGCCCGAGGGGACCAGACAGGCCCGGAGG
AATCGAAGAAGAAGGTGGAGAGCAAGACAGAAACAGATCAACGCGATTAGTGAGCGGATTCTTAGCGCTTGTCTGGG
ACGACCTGCGGAGCCTGTGCCTTTTCATCTACCACCGATTGAGAGACTTCATATTAATTGCAGCGAGAGCGGGGAA
CTTCTGGGACGCAGCAGTCTCAAGGGACTACGGAGAGGATGGGAAGCCCTTAAGTATCTGGGAAGTCTTGTGCAGTA
TTGGGGCCTGGAACTAAAAAGGAGTGCTATTAGTCTATTGGATACCCTAGCAATAACAGTAGGTGAAGGAACAGATA
GGATTCTAGAATTTGTATTAGGAATTTGTAGAGCTATCCGCAACATACCTACAAGAATAAGACAGGGCTTTGAAACA
GCTTTGCTATAA
>703010505.W22.19
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTACCAATGCTACTGCCAGCAATAGCAGTATAATAGAGGGAATGAAAAATTGCTCTTTCAATATAACCACA
GAATTAAGAGATAAGAGAGAGAAAAAGAATGCACTTTTTTATAAACTTGATATAGTACAACTAGATGGCAACTCTAG
TCAGTATAGATTAATAAATTGTAATACCTCAGTCATAACACAAGCCTGTCCAAAGGTCTCTTTTGACCCAATTCCTA
TACATTATTGTGCTCCAGCTGGTTATGCGATTCTAAAGTGTAATAATAAGACATTCACTGGAACAGGACCGTGTAAT
AATGTCAGCACAGTACAATGTACACATGGAATTAAGCCAGTGGTTTCAACTCAACTATTGTTAAATGGTAGCCTAGC
AGAAGGAGAGATAATAATTAGATCTGAAAATATAACAAACAATGGCAAAACAATAATAGTACATCTCAATGAATCTG

FIG. 17B cont'd

```
TAAAGATTGAGTGTACGAGACCCAATAATAAAACAAGAACAAGTATAAGAATAGGACCAGGACAAGCATTTTATGCA
ACAGGACAAGTAATAGGAGACATAAGAGAAGCATATTGTAACATTAGTGAAAGTAAATGGAATGAAACTTTACAAAG
GGTAAGTAAAAAATTAAAAGAATACTTCCCTCATAAGAATATAACATTTCAACCATCCTCAGGAGGGACCTAGAAAT
TACAACACATAGCTTTAATTGTGGAGGAGAATTTTTCTATTGCAATACATCAAGCCTGTTTAATAGGACATATATGG
CTAATAGTACAGATATGGCTAATAGTACAGAAACTAACAGTACACGAACCATCACAATCCGCTGCAGAATAAAACAA
ATTATAAACATGTGGCAGGAGGTGGGACGAGCAATGTATGCCCCTCCCATTGCAGGAAACATAACATGTATATCAAA
TATCACAGGACTACTATTGACAAGGGATGGAGGAAAAAACAATACGGAGACATTCAGACCTGGAGGAGGAAATATGA
AGGACAATTGGAGAAGTGAATTATATAAATATAAAGTGGTAGAAGTTAAGCCATTAGGAGTAGCACCCACTAATGCA
AGAAGGAGAGTGGTGGAGAGAGAAAAAGAGCAGTGGGAATGGGAGCTGTGTTCCTTGGGTTCTTGGGAGCGGCAGG
AAGCACTATGGGCGCAGCATCAATAACGCTGACGGTACAGGCCAGACAATTATTGTCTGGTATAGTGCAACAGCAAA
GCAATTTGCTGAAGGCTATAGAGGCTCAACAGCATATTGTTGAAACTCACGGTCTGGGGCATTAAACAGCTCCAGGCA
AGAGTCCTGGCCTTGGAAAGATACCTAAAGGATCAACAGCTCCTAGGGATGTGGGGCTGCTCTGGAAAACTCATCTG
CACCACTAATGTATATTGGAACTCTAGTTGGAGTAATAAAACTTATAGTGATATTTGGGATAACATGACCTGGATGC
AGTGGGAGAGAGAAATTAGCAATTATACAGAAATAATATATGAATTGCTTGAAGAATCACAAAACCAGCAGGAAAAG
AATGAACAAGATTTACTAGCATTGGACAGATGGAACAGTCTGTGGAACTGGTTTAACATAACAAATTGGCTGTGGTA
TATAAAAATATTCATAATGATAGTAGGAGGCTTGATAGGTTTAAGAATAATTTTTGCTGTGCTTTCTTTAGTAAATA
GAGTTAGGCAGGGATACTCACCTCTGTCGTTGCAGACCCTTATCCCAAGCCCGAGGGGACCAGACAGGCCCGGAGGA
ATCGAAGAAGAAGGTGGAGAGCAAGACAGAAACAGATCAACGCGATTAGTGAGCGGATTCTTAGCGCTTGTCTGGGA
CGACCTGCGGAGCCTGTGCCTTTTCATCTACCACCGATTGAGAGACTTCATATTAATTGCAGCGAGAGCGGGGGAAC
TTCTGGGACGCAGCAGTCTCAAGGGACTATGGAGAGGATGGGAAGCCCTTAAGTATCTGGGAAGTCTTGTGCAGTAT
TGGGGCCTGGAACTAAAAGGAGTGCTATTAGTCTATTGGATACCCTAGCAATAGCAGTAGGTGAAGGAACAGATAG
GATTCTAGAATTTGTATTAGGAATTTGTAGAGCTATCCGCAACATACCTACAAGAATAAGACAGGGCTTTGAAACAG
CTTTGCTATAA
>703010505.W22.15
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCGGCAATAGCAGTATAATAGAGGAAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGCCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAGTGAAAGTAAATGGAATGAAACTTTACAAAGGGTAAGTAAAAA
ATTAAAAGAATACTTCCCTCATAAGAATATAACATTTCAACCATCCTCAGGAGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCGCTGCAGAATAAGACAAATTATAAACAT
GTGGCAGGAGGTGGGACGAGCAATGTATGCCCCTCCCATTGCAGGAAACATAACATATATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAGGTCTTGTGCAGTATTGGGGCCTGGA
ACTAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W22.9
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAGAGGGAATGAAAAATTGCTCTTTCAATATAACCACAGAATTAAGAGATAAG
AGAGAGAAAAAGAATGCACTTTTTATAAACTTGATATAGTACAACTAGATGGCAACTCTAGTCAGTATAGATTAAT
AAATTGTAATACCTCAGTCATAACACAAGCCTGTCCAAAGGTCTCTTTTGACCCAATTCCTATACATTATTGTGCTC
CAGCTGGTTATGCGATTCTAAAGTGTAATAATAAGACATTCACTGGAACAGGACCGTGTAATAATGTCAGCACAGTA
CAATGTACACATGGAATTAAGCCAGTGGTTTCAACTCAACTATTGTTAAATGGTAGCCTAGCAGAAGGAGAGATAAT
AATTAGATCTGAAAATATAACAAACAATGCCAAAACAATAATAGTGCATCTCAATGAATCTGTAAAGATTGAGTGTA
CGAGACCCAATAACAAAACAAGAACAAGTATAAGAATAGGACCAGGACAAGCATTTTATGCAACAGGACAAGTAATA
```

FIG. 17B cont'd

```
GGAGACATAAGAGAAGCATATTGTAACATTAGTGAAAGTAAATGGAATGAAACTTTACAAAGGGTAAGTAAAAAATT
AAAAGAATACTTCCCTCATAAGAATATAACATTTCAACCATCCTCAGGAGGGGACCTAGAAATTACAACACATAGCT
TTAATTGTGGAGGAGAATTTTTCTATTGCAATACATCAAGCCTGTTTAATAGGACATATATGGCTAATAGTACAGAT
ATGGCTAATAGTACAGAAACTAACAGTACACGAATCATCACAATCCACTGCAGAATAAAACAAATTATAAACATGTG
GCAGGAGGTGGGACGAGCAATGTATGCCCCTCCCATTGCAGGAAACATAACATGTATATCAAATATCACAGGACTAC
TATTGACAAGGGATGGAGGGAAAAAACAATACGGAGACGTTCAGACCTGGAGGAGGAAATATGAAGGACAATTGGAGA
AGTGAATTATATAAATATAAAGTGGTAGAAGTTAAGCCATTAGGAGTAGCACCCACTAATGCAAGAAGGAGAGTGGT
GGAGAGAGAAAAAGAGCAGTGGGAATGGGAGCTGTGTTCCTTGGGTTCTGGGAGCGGCAGGAAGCACTATGGGCG
CAGCATCAATAACGCTGACGGTACAGGCCAGACAATTATTGTCTGGTATAGTGCAACAGCAAAGCAATTTGCTGAAG
GCTATAGAGGCTCAACAGCATATGTTGAAACTCACGGTCTGGGGCATTAAACAGCTCCAGGCAAGAGTCCTGGCCTT
GGAAAGATACCTAAAGGATCAACAGCTCCTAGGGATGTGGGGCTGCTCTGGAAAACTCATCTGCACCACTAATGTAT
ATTGGAACTCTAGTTGGAGTAATAAAACTTATGGTGATATTTGGGATAACATGACCTGGATGCAGTGGGAGAGAA
ATTAGCAATTATACAGAAATAATATATGAATTGCTTGAAGAATCACAAAACCAGCAGGAAAAGAATGAACAAGATTT
ACTAGCATTGGACAGATGGAACAGTCTGTGGAATTGGTTTAACATAACAAATTGGCTGTGGTATATAAAAATATTCA
TAATGATAGTAGGAGGCTTGATAGGTTTAAGAATAATTTTTGCTGTGCTTTCTTTAGTAAATAGAGTTAGGCAGGGA
TACTCACCTCTGTCGTTGCAGACCCTTATCCCAAGCCCGAGGGGACCAGACAGGCCCGGAGGAATCGAAGAAGAAGG
TGGAGAGCAAGACAGAAACAGATCAACGCGATTAGTGAGCGGATTCTTAGCGCTTGTCTGGGACGACCTGCGGAGCC
TGTGCCTTTTCATCTACCACCGATTGAGAGACTTCATATTAATTGCAGCGAGAGCGGGGGAACTTCTGGGACGCAGC
AGTCTCAAGGGACTACGGAGAGGATGGGAAGCCCTTAAGTATCTGGGAAGTCTTGTGCAGTATTGGGGCCTGGAACT
AAAAAGGAGTACTATTAGTCTATTGGATACCCTAGCAATAGCAGTAGGTGAAGGAACAGATAGGATTCTAGAATTTG
TATTAGGAATTTGTAGAGCTATCCGCAACATACCTACAAGAATAAGACAGGGCTTTGAAACAGCTTTGCTATAA
>703010505.W22.22
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATCTCTGGGCTACACATGCCTGTGTACCCACAGACCCCAATCCA
CAAGAAATGGTTTTAAAAAAATGTAACAGAAAATTTCAACATGTGGAAAAATGACATGGTGGATCAGATGCATGAAGA
CGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAATAGAGGAAATGAAAAATTGCTCTTTCAATATAATCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTCAACTCAACTATTGTTAAATGGTAGCCTAGCAGAAGGAGAGAT
AATAATTAGATCTGAAAATATAACAAACAATGTCAAACAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAATGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAAACATCACAGACCTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W22.26
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATCTCTGGGCTACACATGCCTGTGTACCCACAGACCCCAATCCA
CAAGAAATGGTTTTAAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTAATGCTACTGCCAGCAATAGCAGTATAATAGAGGGAATGAAAAATTGCTCTTTCAATATAACCACAGAA
TTAAGAGATAAGAGAGAGAAAAGAATGCACTTTTTTATAAACTTGATATAGTACAACTAGATGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCACTGGAACAGGACCGTGTAATAAT
GTCAGCACAGTACAATGTACACATGGAATTAAGCCAGTGGTTCAACTCAACTATTGTTAAATGGTAGCCTAGCAGA
AGGAGAGATAATAATTAGATCTGAAAATATAACAAACAATGGCAAAACAATAATAGTACATCTCAATGAATCTGTAA
AGATTGAGTGTACGAGACCCAATAATAAAACAAGAACAAGTATAAGAATAGGACCAGGACAAGCATTTTATGCAACA
GGACAAGTAATAGGAGACATAAGAGAAGCATATTGTAACATTAGTGAAAGTAAATGGAATGAAACTTTACAAAGGGT
AAGTAAAAAATTAAAAGAATACTTCCCTCATAAGAATATAACATTTCAACCATCCTCAGGAGGGGACCTAGAAATTA
```

FIG. 17B cont'd

```
CAACACATAGCTTTAATTGTGGAGGAGAATTTTTCTATTGCAATACATCAAGCCTGTTTAATAGGACATATATGGCT
AATAGTACAGATATGGCTAATAGTACAGAAACTAACAGTACACGAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAAAAACAATACGGAGACATTCAGACCTGGAGGAGGAAATATGAAG
GACAATTGGAGAAGTGAATTATATAAATATAAAGTGGTAGGAGTTAAGCCATTAGGAGTAGCACCCACTAATGCAAG
AAGGAGAGTGGTGGAGAGAGAAAAAAGAGCAGTGGGAATGGGAGCTGTGTTCCTTGGGTTCTTGGGAGCGGCAGGAA
GCACTATGGGCGCAGCATCAATAACGCTGACGGTACAGGCCAGACAATTATTGTCTGGTATAGTGCAACAGCAAAGC
AATTTGCTGAAGGCTATAGAGGCTCAACAGCATATGTTGAAACTCACGGTCTGGGGCATTAAACAGCTCCAGGCAAG
AGTCCTGGCCTTGGAAAGATACCTAAAGGATCAACAGCTCCTAGGGATGTGGGGCTGCTCTGGAAAACTCATCTGCA
CCACTAATGTATATTGGAACTCTAGTTGGAGTAATAAAACTTATGGTGATATTTGGGATAACATGACCTGGATGCAG
TGGGAGAGAGAAATTAGCAATTATACAGAAATAATATATGAATTGCTTGAAGAATCACAAAACCAGCAGGAAAAGAA
TGAACAAGATTTACTAGCATTGGACAGATGGAACAGTCTGTGGAATTGGTTTAACATAACAAATTGGCTGTGGTATA
TAAAAATATTCATAATGATAGTAGGAGGCTTGATAGGTTTAAGTAATAATTTTTGCTGTGCTTTCTTTAGTAAATAG
AGTTAGGCAGGGATACTCACCTCTGTCGTTGCAGACCCTTATCCCAAGCCCGAGGGGACCAGACAGGCCCGGAGGAA
TCGAAGAAGAAGGTGGAGAGCAAGACAGAAACAGATCAACGCGATTAGTGAGCGGATTCTTAGCGCTTGTCTGGGAC
GACCTGCGGGACCTGTGCCTTTTCATCTACCACCGATTGAGAGACTTCATATTAATTGCAGCGAGAGCGGGGAACT
TCTGGGACGCAGCAGTCTCAAGGGACTACGGAGAGGATGGGAAGCCCTTAAGTATCTGGGAAGTCTTGTGCAGTATT
GGGGCCTGGAACTAAAAAGGAGTGCTATTAGTCTATTGGATACCCTAGCAATAGCAGTAGGTGAAGGAACAGATAGG
ATTCTAGAATTTGTATTAGGAATTTGTAGAGCTATCCGCAACATACCTACAAGAATAAGACAGGGCTTTGAAACAGC
TTTGCTATAA
>703010505.W22.24
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAGAGGGAATGAAAAATTGCTCTTTCAATATAACCACAGAATTAAGAGATAAG
AGAGAGAAAAAGAATGCACCTTTTTATAAACTTGATATAGTACAACTAGATGGCAACTCTAGTCAGTATAGATTAAT
AAATTGTAATACCTCAGTCATAACACAAGCCTGTCCAAAGGTCTCTTTTGACCCAATTCCTATACATTATTGTGCTC
CAGCTGGTTATGCGATTCTAAAGTGTAATAATAAGACATTCACTGGAACAGGACCGTGTAATAATGTCAGCACAGTA
CAATGTACACATGGAATTAAGCCAGTGGTTTCAACTCAACTATTGTTAAATGGTAGCCTAGCAGAAGGAGAGATAAT
AATTAGATCTGAAATATAACAAACAATGGCAAAACAATAATAGTACATCTCAATGAATCTGTAAAGATTGAGTGTA
CGAGACCCAATAATAAAACAAGAACAAGTATAAGAATAGGACCAGGACAAGCATTTTATGCAACAGGACAAGTAATA
GGAGACATAAGAGAAGCATATTGTAACATTAGTGAAAGTAAATGGAATGAAACTTTACAAAGGGTAAGTAAAAAATT
AAAAGAATACTTCCCTCATAAGAATATAACATTTCAACCATCCTCAGGAGGGGACCTAGAAATTACAACACATAGCT
TTAATTGTGGAGGAGAATTTTTCTATTGCAATACATCAAGCCTGTTTAATAGGACATATATGGCTAATAGTACAGAT
ATGGCTAATAGTACAGAAACTAACAGTAAACGAACCATCACAATCCACTGCAGAATAAAATTATAAACATGTG
GCAGGAGGTGGGACGAGCAATGTATGCCCCTCCCATTGCAGGAAACATAACATGTATATCAAATATCACAGGACTAC
TATTGACAAGGGATGGAGGAAAAAACAATACGGAGACATTCAGACCTGGAGGAGGAAATATGAAGGACAATTGGAGA
AGTGAATTATATAAATATAAAGTGGTAGAAGTTAAGCCATTAGGAGTAGCACCCACTAATGCAAGAAGGAGAGTGGT
GGAGAGAGAAAAAAGAGCAGTGGGAATGGGAGCTGTGTTCCTTGGGTTCTTGGGAGCGGCAGGAAGCACTATGGGCG
CAGCATCAATAACGCTGACGGTACAGGCCAGACAATTATTGTCTGGTATAGTGCAACAGCAAAGCAATTTGCTGAAG
GCTATAGAGGCTCAACAGCATATGTTGAAACTCACGGTCTGGGGCATTAAACAGCTCCAGGCAAGAGTCCTGGCCTT
GGAAAGATACCTAAAGGATCAACAGCTCCTAGGGATGTGGGGCTGCTCTGGAAAACTCATCTGCACCACTAATGTAT
ATTGGAACTCTAGTTGGAGTAATAAAACTTATGGTGATATTTGGGATAACATGACCTGGATGCAGTGGGAGAGAGAA
ATTAGCAATTATACAGAAATAATATATGAATTGCTTGAAGAATCACAAAACCAGCAGGAAAAGAATGAACAAGATTT
ACTAGCATTGGACAGATGGAACAGTCTGTGGAATTGGTTTAACATAACAAATTGGCTGTGGTATATAAAAATATTCA
TAATGATAGTAGGAGGCTTGATAGGTTTAAGAATAATTTTTGCTGTGCTTTCTTTAGTAAATAGAGTTAGGCAGGGA
TACTCACCTCTGTCGTTGCAGACCCTTATCCCAAGCCCGAGGGGACCAGACAGGCCCGGAGGAATCGAAGAAGAAGG
TGGAGAGCAAGACAGAAACAGATCAACGCGATTAGTGAGCGGATTCTTAGCGCTTGTCTGGGACGACCTGCGGAGCC
TGTGCCTTTTCATCTACCACCGATTGAGAGACTTCATATTAATTGCAGCGAGAGCGGGGAACTTCTGGGACGCAGC
AGTCTCAAGGGACTAAGGAGAGGATGGGAAGCCCTTAAGTATCTGGGAAGTCTTGTGCAGTATTGGGGCCTGGAACT
AAAAAGGAGTGCTATTAGTCTATTGGATACCCTAGCAATAGCAGTAGGTGAAGGAACAGATAGGATTCTAGAATTTG
TATTAGGAATTTGTAGAGCTATCCGCAACATACCTACAAGAATAAGACAGGGCTTTGAAACAGCTTTGCTATAA
>703010505.W22.23
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTTCCCACAGACCCCAATCCA
CAAGAAATGGTGTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATGCTACTGCCAGCAATAGCAGTATAATAGAGGGAATGAAAAATTGCTCTTTCAATATAACC
ACAGAATTAAGAGATAAGAGAGAGAAAAAGAATGCACTTTTTTATAAACTTGATATAGTACAACTAGATGGCAACTC
TAGTCAGTATAGATTAATAAATTGTAATACCTCAGTCATAACACAAGCCTGTCCAAAGGTCTCTTTTGACCCAATTC
CTATACATTATTGTGCTCCAGCTGGTTATGCGATTCTAAAGTGTAATAATAAGACATTCACTGGAACAGGACCGTGT
AATAATGTCAGCACAGTAATGTACACATGGAATTAAGCCAGTGGTTTCAACTCAACTATTGTTAAATGGTAGCCT
AGCAGAAGGAGAGATAATAATTAGATCTGAAAATATAACAAACAATGCCAAAACAATAATAGTACATCTCAATGAAT
CTGTAAAGATTGAGTGTACGAGACCCAATAATAAAACAAGAACAAGTATAAGAATAGGACCAGGACAAGCATTTTAT
GCAACAGGACAAGTAATAGGAGACATAAGAGAAGCATATTGTAACATTAGTGAAAGTAAATGGAATGAAACTTTACA
AAGGGTAAGTAAAAAATTAAAAGAATACTTCCCTCATAAGAATATAACATTTCAACCATCCTCAGGAGGGGACCTAG
AAATTACAACACATAGCTTTAATTGTGGAGGAGAATTTTTCTATTGCAATACATCAAGCCTGTTTAATAGGACATAT
```

FIG. 17B cont'd

```
ATGGCTAATAGTACAGATATGGCTAATAGTACAGAAACTAACAGTACACGAACCATCACAATCCGCTGCAGAATAAA
ACAAATTATAAACATGTGGCAGGAGGTGGGACGAGCAATGTATGCCCCTCCCATTGCAGGAAACATAACATGTATAT
CAAATATCACAGGACTACTATTGACAAGGGATGGAGGAAAAAACAATACGGAGACATTCAGACCTGGAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGGCATCAATAACGCTGACGGTACAGGCCAGCAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGTTGGAGTAATAAAACTTATGGTGATATTTGGGATAACATGACCTGG
ATGCAGTGGGAGAGAGAAATTAGCAATTATACAGAAATAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCGTTACAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGATGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAAGGAACAG
ATAGGATTCTAGAATTTGTATTAGGAATTTGTAGAGCTATCCGCAACATACCTACAAGAATAAGACAGGGCTTTGAA
ACAGCTTTGCTATAA
>703010505.W30.22
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTAATGCTACTGCCAGCAATAGCAGTATAATAGAGGGAATGAAAAATTGCTCTTTCAATATAACCACAGAA
TTAAGAGATAAGAGAGAGAAAAAGAATGCACTTTTTTATAAACTTGATATAGTACAACTAGATGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCACTGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTGAAAATATAACAAACAATGACAAAACAATAATAGTACATCTCAATGAATCTGTAA
AGATTGAGTGTACGAGACCCAGTAATAAAACAAGAACAAGTATAAGAATAGGACCAGGACAAGCATTTTATGCAACA
GGACAAGTAATAGGAGACATAAGAGAAGCATATTGTAACATTAGTGAAAGTAAATGGAATGAAACTTTACAAAGGGT
AAGTAAAAAATTAAAAGAATACTTCCCTCATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
AATAGTACAGATATGGCTGCAGAATAAAACAAATTATAAACATGTGGCAGGAGGTGGGACGAGCAATGTATGCCCCT
CCCATTGCAGGAAACATAACATGTATATCAAATATCACAGGACTACTATTGACAAGGGATGGAGGAAAAAACAATAC
GGAGACATTCAGACCTGGAGGAGGAAATATGAAGGACAATTGGAGAAGTGAATTATATAAATATAAAGTGGTAGAAG
TTAAGCCATTAGGAGTAGCACCCACTAATGCAAGAAGGAGAGTGGTGGAGAGAGAAAAAAGAGCAGTGGGAATGGGA
GCTGTGTTCCTTGGGTTCTTGGGAGCGGCAGGAAGCACTATGGGCGCAGCATCAATAACGCTGACGGTACAGGCCAG
ACAATTATTGTCTGGTATAGTGCAACAGCAAAGCAATTTGCTGAAGGCTATAGAGGCTCAACAGCATATGTTGAAAC
TCACGGTCTGGGGCATTAAACAGCTCCAGGCAAGAGTCCTGGCCTTGGAAAGATACCTAAAGGATCAACAGCTCCTA
GGGATGTGGGGCTGCTCTGGAAAACTCATCTGCACCACTAATGTATATTGGAACTCTAGCTGGAGTAATAAAACTTA
TGGTGATATTTGGGATAACATGACCTGGATGCAGTGGGAGAGAGAAATTAGCAATTATACAGAAATAATATATGAAT
TGCTTGAAGAATCACAAAACCAGCAGGAAAAGAATGAACAAGATTTACTAGCATTGGACAGATGGAACAGTCTGTGG
AATTGGTTTAACATAACAAATTGGCTGTGGTATATAAAAATATTCATAATGATAGTAGGAGGCTTGATAGGTTTAAG
AATAATTTTTGCTGTGCTTTCTTTAGTAAATAGAGTTAGGCAGGGATACTCACCTCTGTCGTTACAGACCCTTATCC
CAAGCCCGAGGGGACCAGACAGGCCCGGAGGAATCGAAGAAGAAGGTGGAGAGCAAGACAGAAACAGATCAACGCGA
TTAGTGAGCGGATTCTTAGCGCTTGTCTGGGACGACCTGCGGAGCCTGTGCCTTTTCATCTACCACCGATTGAGAGA
CTTCATATTAATTGCAGCGAGAGCGGGGAACTTCTGGGACGCAGCAGTCTCAAGGGACTACGGAGAGGATGGGAAG
CCCTTAAGTATCTGGGAAGTCTTGTGCAGTATTGGGGCCTGGAACTAAAAAGGAGTGCTATTAGTCTATTGGATACC
CTAGCAATAGCAGTAGGTGAAGGAACAGATAGGATTCTAGAATTTGTATTAGGAATTTGTAGAGCTATCCGCAACAT
ACCTACAAGAATAAGACAGGGCTTTGAAACAGCTTTGCTATAA
>703010505.W30.11
ATGAGAGTGATGGGGATACAGAGGAATTATCCACAATGGTGGATATGGAGCATGTTAGGCTTTTGGATGCTAATGAT
TTGTAAGGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATATCAGTAATAGAGGAAATGAAAAATTGCTCTTTCAATATAACCACAGAATTAAGAGATAA
GAGAGAGAAAAAGAATGCACTTTTTTATAAACTTGATATAGTACAACTAGATGGCAACTCTAGTCAGTATAGATTAA
TAAATTGTAATACCTCAGTCATAACACAAGCCTGTCCAAAGGTCTCTTTTGACCCAATTCCTATACATTATTGTGCT
CCAGCTGGTTATGCGATTCTAAAGTGTAATAATAAGACATTCACTGGAACAGGACCGTGTAATAATGTCAGCACAGT
ACAATGTACACATGGAATTAAGCCAGTGGTTTCAACTCAACTATTGTTAAATGGTAGCCTAGCAGAAGGAGAGATAA
TAATTAGATCTGAAAATATAACAAACAATGTCAAAACAATAATAGTACATCTCAATGAATCTGTAAAAGATTGAGTGT
ACGAGACCCAATAATAAAACAAGAACAAGTATAAGAATAGGACCAGGACAAGCATTTTATGCAACAGGACAAGTAAT
AGGAGACATAAGAGAAGCATATTGTAACATTAGTGAAAGTAAATGGAATGAAACTTTACAAAGGGTAAGTAAAAAAT
TAAAAGAATACTTCCCTCATAAGAATATAACATTTCAACCATCCTCAGGAGGGGACCTAGAAATTACAACACATAGC
TTTAATTGTGGAGGAGAATTTTTCTATTGCAATACATCAAGCCTGTTTAATAGGACATATATGGCTAATAGTACAGA
AACTAACAGTACACGAACCATCACAATCCGCTGCAGAATAAAACAAATTATAAACATGTGGCAGGAGGTGGGACGAG
```

FIG. 17B cont'd

```
CAATGTATGCCCCTCCCATTGCAGGAAACATAACATGTATATCAAATATCACAGGACTACTATTGACAAGGGATGGA
GGAAAAAACAATACGGATACGGAGACATTCAGACCTGGAGGAGGAAATATGAAGGACAATTGGAGAAGTGAATTATA
TAAATATAAAGTGGTAGAAGTTAAGCCATTAGGAGTAGCACCCACTAATGCAAGAAGGAGAGTGGTGGAGAGAGAAA
AAAGAGCAGTGGGAATGGGAGCTGTGTTCCTTGGGTTCTTGGGAGCGGCAGGAAGCACTATGGGCGCAGCATCAATA
ACGCTGACGGTACAGGCCAGACAATTATTGTCTGGTATAGTGCAACAGCAAAGCAATTTGCTGAAGGCTATAGAGGC
TCAACAGCATATGTTGAAACTCACGGTCTGGGGCATTAAACAGCTCCAGGCAAGAGTCCTGGCCTTGGAAAGATACC
TAAAGGATCAACAGCTCCTAGGGATGTGGGGCTGCTCTGGAAAACTCATCTGCACCACTAATGTATATTGGAACTCT
AGTTGGAGTAATAAAACTTATGGTGATATTTGGGATAACATGACCTGGATGCAGTGGGAGAGAGAAATTAGCAATTA
TACAGAAATAATATATGAATTGCTTGAAGAATCACAAAACCAGCAGGAAAAGAATGAACAAGATTTACTAGCATTGG
ACAGATGGAACAGTCTGTGGAATTGGTTTAACATAACAAATTGGCTGTGGTATATAAAAATATTCATAATGATAGTA
GGAGGCTTGATAGGTTTAAGAATAATTTTTGCTGTGCTTTCTTTAGTAAATAGAGTTAGGCAGGGATACTCACCTCT
GTCGTTACAGACCCTTATCCCAAGCCCGAGGGGACCAGACAGGCCCGGAGGAATCGAAGAAGAAGGTGGAGAGCAAG
ACAGAAACAGATCAACGCGATTAGTGAGCGGATTCTTAGCGCTTGTCTGGGACGACCTGCGGAGCCTGTGCCTTTTC
ATCTACCACCGATTGAGAGACTTCATATTAATTGCAGCGAGAGCGGGGGAACTTCTGGGACGCAGCAGTCTCAAGGG
ACTACGGAGAGGATGGGAAGCCCTTAAGTATCTGGGAAGTCTTGTGCAGTATTGGGGCCTGGAACTAAAAAGGAGTG
CTATTAGTCTATTGGATACCCTAGCAATAGCAATAGGTGAAGGAACAGATAGGATTCTAGAATTTGTATTAGGAATT
TGTAGAGCTATCCGCAACATACCTACAAGAATAAGACAGGGCTTTGAAACAGCTTTGCTATAA
>703010505.W30.20
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTACCAATGCTACTGCCAGCAATAGCAGTATAATAGAGGGAATGAAAAATTGCTCTTTCAATATAACCACA
GAATTAAGAGATAAGAGAGAGAAAAAGAATGCACTTTTTTATAAACTTGATATAGTACAACTAGATGGCAACTCTAG
TCAGTATAGATTAATAAATTGTAATACCTCAGTCATAACACAAGCCTGTCCAAAGGTCTCTTTTGACCCAATTCCTA
TACATTATTGTGCTCCAGCTGGTTATGCGATTCTAAAGTGTAATAATAAGACATTCACTGGAACAGGACCGTGTAAT
AATGTCAGCACAGTACAATGTACACATGGAATTAAGCCAGTGGTTTCAACTCAACTATTGTTAAATGGTAGCCTAGC
AGAAGGAGAGATAATAATTAGATCTGAAAATATAACAAACAATGCCAAAACAATAATAGTACATCTCAATGAATCTG
TAAAGATTGAGTGTACGAGACCCCAATAATAAAACAAGAACAAGTATAAGAATAGGACCAGGACAAGCATTTTATGCA
ACAGGACAAGTAATAGGAGACATAAGAGAAGCATATTGTAACATTAGTGAAAGTAAATGGAATGAAACTTTACAAAG
GGTAAGTAAAAAATTAAAAGAATACTTCCCTCATAAGAATATAACATTTCAACCATCCTCAGGAGGGGACCTAGAAA
TTACAACACATAGCTTTAATTGTGGAGGAGAATTTTTCTATTGCAATACATCAAGCCTGTTTAATAGGACATATATG
GCTAATAGTACAGATATGGCTAATAGTACAGAAACTAACAGTACACGAATCATCACAATCCACTGCAGAATAAAACA
AATTATAAACATGTGGCAGGAGGTGGGACGAGCAATGTATGCCCCTCCCATTGCAGGAAACATAACATGTATATCAA
ATATCACAGGACTACTATTGACAAGGGATGGAGGAAAAAACAAGGGATGGAGGAAAAAACAATACGGAGACATTC
AGACCTGGAGGAGGAAATATGGAGAAGTGAATTGGAGAAGTAATAAAAGTGGTAGAAGTTAAGCCATT
AGGAGTAGCACCCACTAATGCAAGAAGGAGAGTGGTGGAGAGAGAAAAAAGAGCAGTGGGAATGGGAGCTGTGTTCC
TTGGGTTCTTGGGAGCGGCAGGAAGCACTATGGGCGCAGCATCAATAACGCTGACGGTACAGGCCAGACAATTATTG
TCTGGTATAGTGCAACAGCAAAGCAATTTGCTGAAGGCTATAGAGGCTCAACAGCATATGTTGAAACTCACGGTCTG
GGGCATTAAACAGCTCCAGGCAAGAGTCCTGGCCTTGGAAAGATACCTAAAGGATCAACAGCTCCTAGGGATGTGGG
GCTGCTCTGGAAAACTCATCTGCACCACTAATGTATATTGGAACTCTAGTTGGAGTAATAAAACTTATGGTGATATT
TGGGATAACATGACCTGGATGCAGTGGGAGAGAGAAATTAGCAATTATACAGAAATAATATATGAATTGCTTGAAGA
ATCACAAAACCAGCAGGAAAAGAATGAACAAGATTTACTAGCATTGGACAGATGGAACAGTCTGTGGAATTGGTTTA
ACATAACAAATTGGCTGTGGTATATAAAAATATTCATAATGATAGTAGGAGGCTTGATAGGTTTAAGAATAATTTTT
GCTGTGCTTTCTTTAGTAAATAGAGTTAGGCAGGGATACTCACCTCTGTCGTTGCAGACCCCTTATCCCAAGCCCGAG
GGACCAGACAGGCCCGGAGGAATCGAAGAAGAAGGTGGAGAGCAAGACAGAAACAGATCAACGCGATTAGTGAGCG
GATTCTTAGCGCTTGGGACGACCTGCGGAGCCTGTGCCTTTTCATCTACCACCGATTGAGAGACTTCATATTA
ATTGCAGCGAGAGCGGGGAACTTCTGGGACGCAGCAGTCTCAAGGGACTACGGAGAGGATGGGAAGCCCTTAAGTA
TCTGGGAAGTCTTGTGCAGTATTGGGGCCTGGAACTAAAAAGGAGTGCTATTAGTCTATTGGATACCCTAGCAATAG
CAGTAGGTGAAGGAACAGATAGGATTCTAGAATTTGTATTAGGAATTTGTAGAGCTATCCGCAACATACCTACAAGA
ATAAGACAGGGCTTTGAAACAGCTTTGCTATAA
>703010505.W30.12
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTAATGCTACTGCCAGCAATAGCAGTATAATAGAGGGAATGAAAAATTGCTCTTTCAATATAACCACAGAA
TTAAGAGATAAGAGAGAGAAAAAGAATGCACTTTTTTATAAACTTGATATAGTACAACTAGATGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCACTGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTGAAAATATAACAAACAATGACAAAACAATAGTAGTACATCTCAATGAATCTGTAA
AGATTGAGTGTACGAGACCCAGTAATAAAACAAGAACAAGTATAAGAATAGGACCAGGACAAGCATTTTATGCAACA
GGACAAGTAATAGGAGACATAAGAGAAGCATATTGTAACATTAGTGAAAGTAAATGGAATGAAACTTTACAAAGGGT
AAGTAAAAAATTAAAAGAATACTTCCCTCATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
AATAGTACAGATATGGCTAATAGTACAGAAACTAACAGTACACGAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
```

FIG. 17B cont'd

```
TCACAGGACTACTATTGACAAGGGATGGAGGAAAAAACGATACGGAGACATTCAGACCTGGAGGAGGAAATATGAAG
GATAATTGGAGAAGTGAATTATATAAATATAAAGTGGTAGAAGTTAAGCCATTAGGAGTAGCACCCACTAATGCAAG
AAGGAGAGTGGTGGAGAGAGAAAAAAGAGCAGTGGGAATGGGAGCTGTGTTCCTTGGGTTCTTGGGAGCGGCAGGAA
GCACTATGGGCGCAGCATCAATAACGCTGACGGTACAGGCCAGACAATTATTGTCTGGTATAGTGCAACAGCAAAGC
AATTTGCTGAAGGCTATAGAGGCTCAACAGCATATGTTGAAACTCACGGTCTGGGGCATTAAACAGCTCCAGGCAAG
AGTCCTGGCCTTGGAAAGATACCTAAAGGATCAACAGCTCCTAGGGATGTGGGGCTGCTCTGGAAAACTCATCTGCA
CCACTAATGTATATTGGAACTCTAGTTGGAGTAATAAAACTTATGGTGATATTTGGGATAACATGACCTGGATGCAG
TGGGAGGAGAAATTAGCAATTATACAGAAATAATATATATGAATTGCTTGAAGAATCACAAAACCAGCAGGAAAAGAA
TGAACAAGATTTACTAGCATTGGACAGATGGAACAGTCTGTGGAATTGGTTTAACATAACAAATTGGCTGTGGTATA
TAAAAATATTCATAATGATAGTAGGAGGCTTGATAGGTTTAAGAATAATTTTTGCTGTGCTTTCTTTAGTAAATAGA
GTTAGGCAGGGATACTCACCTCTGTCGTTGCAGACCCTTATCCCAAGCCCGAGGGGACCAGACAGGCCCGGAGGAAT
CGAAGAAGAAGGTGGAGAGCAAGACAGAAACAGATCAACGCGATTAGTGAGCGGATTCTTAGCGCTTGTCTGGGACG
ACCTGCGGAGCCTGTGCCTTTTCATCTACCACCGATTGAGAGACTTCATATTAATTGCAGCGAGAGCGGGGAACTT
CTGGGACGCAGCAGTCTCAAGGGACTACGGAGAGGATGGGAAGCCCTTAAGTATCTGGGAAGTCTTGTGCAGTATTG
GGGCCTGGAACTAAAAAGGAGTGCTATTAGTCTATTGGATACCCTAGCAATAGCAGTAGGTGAAGGAACAGATAGGA
TTCTAGAATTTATATTAGGAATTTGTAGAGCTATCCGCAACATACCTACAAGAATAAGACAGGGCTTTGAAACAGCT
TTGCTATAA
>703010505.W30.17
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
CGTAATTAGTTTATGGGATCAAAGCCTCAAGCCATGTGTAAAGTTGACCCCACTCTGTGTTACTCTAAACTGTACCA
ATGCTACTAATGCTACTGCCAGCAATAGCAGTATAATAGAGGGAATGAAAAATTGCTCTTTCAATATAACCACAGAA
TTAAGAGATAAGAGAGAGAAAAAGAATGCACTTTTTTATAAACTTGATATAGTACAACTAGATGGCAACTCCAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCACTGGAACAGGATCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTGAAAATATAACAGACAATGGCAAAACAATAATAGTACATCTCAATGAATCTGTAA
AGATTGAGTGTACGAGACCCAGTAATAAAACAAGAACAAGTATAAGATAGGACCAGGACAAGCATTTTATGCAACA
GGACAAGTAATAGGAGACATAAAAGAAGCATATTGTAACATTAGTGAAAGTAAATGGAATGAAACTTTACAAAGGGT
AAGTAAAAAATTAAAAGAATACTTCCCTCATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
AATAGTACAGATATGGCTAATAGTACAGAAACTAACAGTACACGAAACATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAAAACAATACGGATACGGAGACATTCAGACCTGGAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGTTGGAGTAATAAAACTTATGGTGATATTTGGGATAACATGACCTGG
ATGCAGTGGGAGAGAGAAATTAGCAATTATACAGAAATAATATATGAATTGCTTGAAGAATCACAAAACCAGCAGGA
AAAGAATGAACAAGATTTACTAGCATGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCGTTACAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGTCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGATGGGAAGCCCTTAAGTATCTGGGAAGTCTTGTGCA
GTATTGGGGCCTGGAACTAAAAAGGAGTGCTATTAGTCTATTGGATACCCTAGCAATAGCAATAGGTGAAGGAACAG
ATAGGATTCTAGAATTTGTATTAGGAATTTGTAGAGCTATCCGCAACATACCTACAAGAATAAGACAGGGCTTTGAA
ACAGCTTTGCTATAA
>703010505.W30.31
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
CGTAATTAGTTTATGGGATCAAAGCCTCAAGCCATGTGTAAAGTTGACCCCACTCTGTGTCACTCTAAACTGTACCA
ATGCTACTACCAATGCTACTGCCAGCAATAGCAGTATAATAGAGGGAATGAAAAATTGCTCTTTCAATATAACCACA
GAATTAAGAGATAAGAGAGAGAAAAAGAATGCACTTTTTTATAAACTTGATATAGTACAACTAGATGGCAACTCTAG
TCAGTATAGATTAATAAATTGTAATACCTCAGTCATAACACAAGCCTGTCCAAAGGTCTCTTTTGACCCAATTCCTA
TACATTATTGTGCTCCAGCTGGTTATGCGATTCTAAAGTGTAATAATAAGACATTCACTGGAACAGGACCGTGTAAT
AATGTCAGCACAGTACAATGTACACATGGAATTAAGCCAGTGGTTTCAACTCAACTATTGTTAAATGGTAGCCTAGC
AGAAGGAGAGATAATAATTAGATCTGAAAATATAACAAACAATGCCAAAACAATAATAGTACATCTCAATGAATCTG
TAAAGATTGAGTGTACGAGACCCAGTAATAAAACAAGAACAAGTATAAGATAGGACCAGGACAAGCATTTTATGCA
ACAGGACAAGTAATAGGAGACATAAGAGAAGCATATTGTAACATTAGTGAAAGTAAATGGAATGAAACTTTACAAAG
GGTAAGTAAAAAATTAAAAGAATACTTCCCTCATAAGAATATAACATTTCAACCATCCTCAGGAGGGGACCTAGAAA
TTACAACACATAGCTTTAATTGTGGAGGAGAATTTTTCTATTGCAATACATCAAGCCTGTTTAATAGGACATATATG
GCTAATAGTACAGATATGGCTAATAGTACAGAAACTAACAGTACACGAACCATCACAATCCGCTGCAGAATAAAACA
AATTATAAACATGTGGCAGGAGGTGGGACGAGCAATGTATGCCCCTCCCATTGCAGGAAACATAACATGTATATCAA
```

FIG. 17B cont'd

```
ATATCACAGGACTACTATTGACAAGGGATGGAGGAAAAAACAATACGGATACGGAGACATTCAGACCTGGAGGAGGA
AATATGAAGGACAATTGGAGAAGTGAATTATATAAATATAAAGTGGTAGAAGTTAAGCCATTAGGAGTAGCACCCAC
TAATGCAAGAAGGAGAGTGGTGGAGAGAGAAAAAAGAGCAGTGGGAATGGGAGCTGTGTTCCTTGGGTTCTTGGGAG
CGGCAGGAAGCACTATGGGCGCAGCATCAATAACGCTGACGGTACAGGCCAGACAATTATTGTCTGGTATAGTGCAA
CAGCAAAGCAATTTGCTGAAGGCTATAGAGGCTCAACAGCATATGTTGAAACTCACGGTCTGGGGCATTAAACAGCT
CCAGGCAAGAGTCCTGGCCTTGGAAAGATACCTAAAGGATCAACAGCTCCTAGGGATGTGGGGCTGCTCTGGAAAAC
TCATCTGCACCACTAATGTATATTGGAACTCTAGTTGGAGTAATAAAACTTATGGTGATATTTGGGATAACATGACC
TGGATGCAGTGGGAGAGAGAAATTAGCAATTATACAGAAATAATATATGAATTGCTTGAAGAATCACAAAACCAGCA
GGAAAAGAATGAACAAGATTTACTAGCATTGGACAGATGGAACAGTCTGTGGAATTGGTTTAACATAACAAATTGGC
TGTGGTATATAAAAATATTCATAATGATAGTAGGAGGCTTGATAGGTTTAAGAATAATTTTTGCTGTGCTTTCTTTA
GTAAATAGAGTTAGGCAGGGATACTCACCTCTGTCGTTACAGACCCTTATCCCAAGCCCGAGGGGACCAGACAGGCC
CGGAGGAATCGAAGAAGAAGGTGGAGAGCAAGACAGAAACAGATCAACGCGATTAGTGAGCGGATTCTTAGCGCTTG
TCTGGGACGACCTGCGGAGCCTGTGCCTTTTCATCTACCACCGATTGAGAGACTTCATATTAATTGCAGCGAGAGCG
GGGGAACTTCTAGGACGCAGCAGTCTCAAGGGACTACGGAGAGGATGGGAAGCCCTTAAGTATCTGGGAAGTCTTGT
GCAGTATTGGGGCCTGGAACTAAAAAGGAGTGCTATTAGTCTATTGGATACCCTAGCAATAACAGTAGGTGAAGGAA
CAGATAGGATTCTAGAATTTGTATTAGGAATTTGTAGAGCTATCCGCAACATACCTACAAGAATAAGACAGGGCTTT
GAAACAGCTTTGCTATAA
>703016905.W30.6
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAATGACATGGTGGATCAGATGCATGAAGA
CGTAATTAGTTTATGGGATCAAAGCCTCAAGCCATGTGTAAAGTTGACCCCACTCTGTGTCACTCTAAACTGTACCA
ATGCTACTACCAATGCTACTGCCAGCAATAGCAGTATAATAGAGGGAATGAAAAATTGCTCTTTCAATATAACCACA
GAATTAAGAGATAAGAGAGAGAAAAAGAATGCACTTTTTTATAAACTTGATATAGTACAACTAGATGGCAACTCTAG
TCAGTATAGATTAATAAATTGTAATACCTCAGTCATAACACAAGCCTGTCCAAAGGTCTCTTTTTGACCCAATTCCTA
TACATTATTGTGCTCCAGCTGGTTATGCGATTCTAAAGTGTAATAATAAGACATTCACTGGAACAGGACCGTGTAAT
AATGTCAGCACAGTACAATGTACACATGGAATTAAGCCAGTGGTTTCAACTCAACTATTGTTAAATGGTAGCCTAGC
AGAAGGAGAGATAATAATTAGATCTGAAAATATAACAAACAATGCCAAAACAATAATAGTACATCTCAATGAATCTG
TAAAGATTGAGTGTACGAGACCCAGTAATAAAACAAGAACAAGTATAAGAATAGGACCAGGACAAGCATTTTATGCA
ACAGGACAAGTAATAGGAGACATAAGAGAAGCATATTGTAACATTAGTGAAAGTAAATGGAATGAAACTTTACAAAG
GGTAAGTATAAAAATTAAAGAATACTTCCCTCATAAGAATATAACATTTCAACCATCCTCAGGAGGGGACCCTAGAAA
TTACAACACATAGCTTTAATTGTGGAGGAGAATTTTTCTATTGCAATACATCAAGCCTGTTTAATAGGACATATATG
GCTAATAGTACAGATATGGCTAATAGTACAGAAACTAACAGTACACGAACCATCACAATCCGCTGCAGAATAAAACA
AATTATAAACATGTGGCAGGAGGTGGGACGAGCAATGTATGCCCCTCCCATTGCAGGAAACATAACATGTATATCAA
ATATCACAGGACTACTATTGACAAGGGATGGAGGAAAAAACAATACGGATACGGAGACATTCAGACCTGGAGGAGGA
AATATGAAGGACAATTGGAGAAGTGAATTATATAAATATAAAGTGGTAGAAGTTAAGCCATTAGGAGTAGCACCCAC
TAATGCAAGAAGGAGAGTGGTGGAGAGAGAAAAAAGAGCAGTGGGAATGGGAGCTGTGTTCCTTGGGTTCTTGGGAG
CGGCAGGAAGCACTATGGGCGCAGCATCAATAACGCTGACGGTACAGGCCAGACAATTATTGTCTGGTATAGTGCAA
CAGCAAAGCAATTTGCTGAAGGCTATAGAGGCTCAACAGCATATGTTGAAACTCACGGTCTGGGGCATTAAACAGCT
CCAGGCAAGAGTCCTGGCCTTGGAAAGATACCTAAAGGATCAACAGCTCCTAGGGATGTGGGGCTGCTCTGGAAAAC
TCATCTGCACCACTAATGTATATTGGAACTCTAGTTGGAGTAATAAAACTTATGGTGATATTTGGGATAACATGACC
TGGATGCAGTGGGAGAGAGAAATTAGCAATTATACAGAAATAATATATGAATTGCTTGAAGAATCACAAAACCAGCA
GGAAAAGAATGAACAAGATTTACTAGCATTGGACAGATGGAACAGTCTGTGGAATTGGTTTAACATAACAAATTGGC
TGTGGTATATAAAAGTATTCATAATGATAGTAGGAGGCTTGATAGGTTTAAGAATAATTTTTGCTGTGCTTTCTTTA
GTAAATAGAGTTAGGCAGGGATACTCACCTCTGTCGTTACAGACCCTTATCCCAAGCCCGAGGGGACCAGACAGGCC
CGGAGGAATCGAAGAAGAAGGTGGAGAGCAAGACAGAAACAGATCAACGCGATTAGTGAGCGGATTCTTAGCGCTTG
TCTGGGACGACCTGCGGAGCCTGTGCCTTTTCATCTACCACCGATTGAGAGACTTCATATTAATTGCAGCGAGAGCG
GGGGAACTTCTGGGACGCAGCAGTCTCAAGGGACTACGGAGAGGATGGGAAGCCCTTAAGTATCTGGGAAGTCTTGT
GCAGTATTGGGGCCTGGAACTAAAAAGGAGTGCTATTAGTCTATTGGATACCCTAGCAATAACAGTAGGTGAAGGAA
CAGATAGGATTCTAGAATTTGTATTAGGAATTTGTAGAGCTATCCGCAACATACCTACAAGAATAAGACAGGGCTTT
GAAACAGCTTTGCTATAA
>703016905.W30.7
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAATGACATGGTGGATCAGATGCATGAAGAC
GTAATTAGTTTATGGGATCAAAGCCTCAAGCCATGTGTAAAGTTGACCCCACTCTGTGTCACTCTAAACTGTACCAA
TGCTACTACCAATGCTACTGCCAGCAATAGCAGTATAATAGAGGGAATGAAAAATTGCTCTTTCAATATAACCACAG
AATTAAGAGATAAGAGAGAGAAAAAGAATGCACTTTTTTATAAACTTGATATAGTACAACTAGATGGCAACTCTAGT
CAGTATAGATTAATAAATTGTAATACCTCAGTCATAACACAAGCCTGTCCAAAGGTCTCTTTTTGACCCAATTCCTAT
ACATTATTGTGCTCCAGCTGGTTATGCGATTCTAAAGTGTAATAATAAGACATTCACTGGAACAGGACCGTGTAATA
ATGTCAGCACAGTACAATGTACACATGGAATTAAGCCAGTGGTTTCAACTCAACTATTGTTAAATGGTAGCCTAGCA
GAAGGAGAGATAATAATTAGATCTGAAAATATAACAAACAATGCCAAAACAATAATAGTACATCTCAATGAATCTGT
AAAGATTGAGTGTACGAGACCCAGTAATAAAACAAGAACAAGTATAAGAATAGGACCAGGACAAGCATTTTATGCAA
CAGGACAAGTAATAGGAGACATAAGAGAAGCATATTGTAACATTAGTGAAAGTAAATGGAATGAAACTTTACAAAGG
GTAAGTAAAAAATTAAAGAATACTTCCCTCATAAGAATATAACATTTCAACCATCCTCAGGAGGGGACCTAGAAAT
TACAACACATAGCTTTAATTGTGGAGGAGAATTTTTCTATTGCAATACATCAAGCCTGTTTAATAGGACATATATGG
CTAATAGTACAGATATGGCTAATAGTACAGAAACTAACAGTACACGAACCATCACAATCCGCTGCAGAATAAAACAA
ATTATAAACATGTGGCAGGAGGTGGGACGAGCAATGTATGCCCCTCCCATTGCAGGAAACATAACATGTATATCAAA
```

FIG. 17B cont'd

```
TATCACAGGACTACTATTGACAAGGGATGGAGGAAAAAACAATACGGATACGGAGACATTCAGACCTGGAGGAGGAA
ATATGAAGGACAATTGGAGAAGTGAATTATATAAATATAAAGTGGTAGAAGTTAAGCCATTAGGAGTAGCACCCACT
AATGCAAGAAGGAGAGTGGTGGAGAGAGAAAAAAGAGCAGTGGGAATGGGAGCTGTGTTCCTTGGGTTCTTGGGAGC
GGCAGGAAGCACTATGGGCGCAGCATCAATAACGCTGACGGTACAGGCCAGACAATTATTGTCTGGTATAGTGCAAC
AGCAAAGCAATTTGCTGAAGGCTATAGAGGCTCAACAGCATATGTTGAAACTCACGGTCTGGGGCATTAAACAGCTC
CAGGCAAGAGTCCTGGCCTTGGAAAGATACCTAAAGGATCAACAGCTCCTAGGGATGTGGGGCTGCTCTGGAAAACT
CATCTGCACCACTAATGTATATTGGAACTCTAGTTGGAGTAATAAAACTTATGGTGATATTTGGGATAACATGACCT
GGATGCAGTGGGAGAGAGAAATTAGCAATTATACAGAAATAATATATGAATTGCTTGAAGAATCACAAAACCAGCAG
GAAAAGAATGAACAAGATTTACTAGCATTGGACAGATGGAACAGTCTGTGGAATTGGTTTAACATAACAAATTGGCT
GTGGTATATAAAAATATTCATAATGATAGTAGGAGGCTTGATAGGTTTAAGAATAATTTTTGCTGTGCTTTCTTTAG
TAAATAGAGTTAGGCAGGGATACTCACCTCTGTCGTTACAGACCCTTATCCCAAGCCCGAGGGGACCAGACAGGCCC
GGAGGAATCGAAGAAGAAGGTGGAGAGCAAGACAGAAACAGATCAACGCGATTAGTGAGCGGATTCTTAGCGCTTGT
CTGGGACGACCTGCGGAGCCTGTGCCTTTTCATCTACCACCGATTGAGAGACTTCATATTAATTGCAGCGAGAGCGG
GGGAACTTCTGGGACGCAGCAGTCTCAAGGGACTACGGAGAGGATGGGAAGCCCTTAAGTATCTGGGAAGTCTTGTG
CAGTATTGGGGCCTGGAACTAAAAAGGAGTGCTATTAGTCTATTGGATACCCTAGCAATAACAGTAGGTGAAGGAAC
AGATAGGATTCTAGAATTTGTATTAGGAATTTGTAGAGCTATCCGCAACATACCTACAAGAATAAGACAGGGCTTTG
AAACAGCTTTGCTATAA
>703016565.W30.8
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAATGACATGGTGGATCAGATGCATGAAGA
CGTAATTAGTTTATGGGATCAAAGCCTCAAGCCATGTGTAAAGTTGACCCCACTCTGTGTCACTCTAAACTGTACCA
ATGCTACTACCAATGCTACTGCCAGCAATAGCAGTATAATAGAGGGAATGAAAAATTGCTCTTTCAATATAACCACA
GAATTAAGAGATAAGAGAGAGAAAAAGAATGCACTTTTTTATAAACTTGATATAGTACAACTAGATGGCAACTCTAG
TCAGTATAGATTAATAAATTGTAATACCTCAGTCATAACACAAGCCTGTCCAAAGGTCTCTTTTGACCCAATTCCTA
TACATTATTGTGCTCCAGCTGGTTATGCGATTCTAAAGTGTAATAATAAGACATTCACTGGAACAGGACCGTGTAAT
AATGTCAGCACAGTACAATGTACACATGGAATTAAGCCAGTGGTTTCAACTCAACTATTGTTAAATGGTAGCCTAGC
AGAAGGAGAGATAATAATTAGATCTGAAAATATAACAAACAATGCCAAAACAATAATAGTACATCTCAATGAATCTG
TAAAGATTGAGTGTACGAGACCCAGTAATAAAACAAGAACAAGTATAAGGATAGGACCAGGACAAGCATTTTATGCA
ACAGGACAAGTAATAGGAGACATAAGAGAAGCATATTGTAACATTAGTGAAAGTAAATGGAATGAAACTTTACAAAG
GGTAAGTAAAAAATTAAAAGAATACTTCCCTCATAAGAATATAACATTTCAACCATCCTCAGGAGGGGACCTAGAAA
TTACAACACATAGCTTTAATTGTGGAGGAGAATTTTTCTATTGCAATACATCAAGCCTGTTTAATAGGACATATATG
GCTAATAGTACAGATATGGCTAATAGTACAGAAACTAACAGTACACGAACCATCACAATCCGCTGCAGAATAAAACA
AATTATAAACATGTGGCAGGAGGTGGGACGAGCAATGTATGCCCCTCCCATTGCAGGAAACATAACATGTATATCAA
ATATCACAGGACTACTATTGACAAGGGATGGAGGAAAAAACAATACGGATACGGAGACATTCAGACCTGGAGGAGGA
AATATGAAGGACAATTGGAGAAGTGAATTATATAAATATAAAGTGGTAGAAGTTAAGCCATTAGGAGTAGCACCCAC
TAATGCAAGAAGGAGAGTGGTGGAGAGAGAAAAAAGAGCAGTGGGAATGGGAGCTGTGTTCCTTGGGTTCTTGGGAG
CGGCAGGAAGCACTATGGGCGCAGCATCAATAACGCTGACGGTACAGGCCAGACAATTATTGTCTGGTATAGTGCAA
CAGCAAAGCAATTTGCTGAAGGCTATAGAGGCTCAACAGCATATGTTGAAACTCACGGTCTGGGGCATTAAACAGCT
CCAGGCAAGAGTCCTGGCCTTGGAAAGATACCTAAAGGATCAACAGCTCCTAGGGATGTGGGGCTGCTCTGGAAAAC
TCATCTGCACCACTAATGTATATTGGAACTCTAGTTGGAGTAATAAAACTTATGGTGATATTTGGGATAACATGACC
TGGATGCAGTGGGAGAGAGAAATTAGCAATTATACAGAAATAATATATGAATTGCTTGAAGAATCACAAAACCAGCA
GGAAAAGAATGAACAAGATTTACTAGCATTGGACAGATGGAACAGTCTGTGGAATTGGTTTAACATAACAAATTGGC
TGTGGTATATAAAAATATTCATAATGATAGTAGGAGGCTTGATAGGTTTAAGAATAATTTTTGCTGTGCTTTCTTTA
GTAAATAGAGTTAGGCAGGGATACTCACCTCTGTCGTTACAGACCCTTATCCCAAGCCCGAGGGGACCAGACAGGCC
CGGAGGAATCGAAGAAGAAGGTGGAGAGCAAGACAGAAACAGATCAACGCGATTAGTGAGCGGATTCTTAGCGCTTG
TCTGGGACGACCTGCGGAGCCTGTGCCTTTTCATCTACCACCGATTGAGAGACTTCATATTAATTGCAGCGAGAGCG
GGGGAACTTCTGGGACGCAGCAGTCTCAAGGGACTACGGAGAGGATGGGAAGCCCTTAAGTATCTGGGAAGTCTTGT
GCAGTATTGGGGCCTGGAACTAAAAAGGAGTGCTATTAGTCTATTGGATACCCTAGCAATAACAGTAGGTGAAGGAA
CAGATAGGATTCTAGAATTTGTATTAGGAATTTGTAGAGCTATCCGCAACATACCTACAAGAATAAGACAGGGCTTT
GAAACAGCTTTGCTATAA
>703016565.W30.25
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTACCAATGCTACTGCCAGCAATAGCAGTATAATAGAGGGAATGAAAAATTGCTCTTTCAATATAACCACA
GAATTAAGAGATAAGAGAGAGAAAAAGAATGCACTTTTTTATAAACTTGATATAGTACAACTAGATGGCAACTCTAG
TCAGTATAGATTAATAAATTGTAATACCTCAGTCATAACACAAGCCTGTCCAAAGGTCTCTTTTGACCCAATTCCTA
TACATTATTGTGCTCCAGCTGGTTATGCGATTCTAAAGTGTAATAATAAGACATTCACTGGAACAGGACCGTGTAAT
AATGTCAGCACAGTACAATGTACACATGGAATTAAGCCAGTGGTTTCAACTCAACTATTGTTAAATGGTAGCCTAGC
AGAAGGAGAGATAATAATTAGATCTGAAAATATAACAAACAATGCCAAAACAATAATAGTACATCTCAATGAATCTG
TAAAGATTGAGTGCAGAGACCCAATAATAAAACAAGAACAAGTATAAGAATAGGACCAGGACAAGCATTTTATGCA
ACAGGACAAGTAATAGGAGACATAAGAGAAGCACATTGTAACATTAGTGAAAGTAAATGGAATGAAACTTTACAAAG
GGTAAGTAAAAAATTAAAAGAATACTTCCCTCATAAGAATATAACATTTCAACCATCCTCAGGAGGGGACCTAGAAA
TTACAACACATAGCTTTAATTGTGGAGGAGAATTTTTCTATTGCAATACATCAAGCCTGTTTAATAGGACATATATG
GCTAATAGTACAGATATGGCTAATAGTACAGAAACTAACAGTACACGAACCATCACAATCCGCTGCAGAATAAAACA
AATTATAAACATGTGGCAGGAGGTGGGACGAGCAATGTATGCCCCTCCCATTGCAGGAAACATAACATGTATATCAA
```

FIG. 17B cont'd

ATATCACAGGACTACTATTGACAAGGGATGGAGGAAAAAACAATACGGATACGGAGACATTCAGACCTGGAGGAGGA
AATATGAAGGACAATTGGAGAAGTGAATTATATAAATATAAAGTGGTAGAAGTTAAGCCATTAGGAGTAGCACCCAC
TAATGCAAGAAGGAGAGTGGTGGAGAGAGAAAAAAGAGCAGTGGGAATGGGAGCTGTGTTCCTTGGGTTCTTGGGAG
CGGCAGGAAGCACTATGGGCGCAGCATCAATAACGCTGACGGTACAGGCCAGACAATTATTGTCTGGTATAGTGCAA
CAGCAAAGCAATTTGCTGAAGGCTATAGAGGCTCAACAGCATATGTTGAAACTCACGGTCTGGGGCATTAAACAGCT
CCAGGCAAGAGTCCTGGCCTTGGAAAGATACCTAAAGGATCAACAGCTCCTAGGGATGTGGGGCTGCTCTGGAAAAC
TCATCTGCACCACTAATGTATATTGGAACTCTAGTTGGAGTAATAAAACTTATGGTGATATTTGGGATAACATGACC
TGGATGCAGTGGGAGAGAGAAATTAGCAATTATACAGAAATAATATATGAATTGCTTGAAGAATCACAAAACCAGCA
GGAAAAGAATGAACAAGATTTACTAGCATTGGACAGATGGAACAATCTGTGGAATTGGTTTAACATAACAAATTGGC
TGTGGTATATAAAAATATTCATAATGATAGTAGGAGGCTTGATAGGTTTAAGAATAATTTTTGCTGTGCTTTCTTTA
GTAAATAGAGTTAGGCAGGGATACTCACCTCTGTCGTTGCAGACCCTTATCCCAAGCCCGAGGGGACCAGACAGGCC
CGGAGGAATCGAAGAAGAAGGTGGAGAGCAAGACAGAAACAGATCAACGCGATTAGTGAGCGGATTCTTAGCGCTTG
TCTGGGACGACCTGCGGAGCCTGTGCCTTTTCATCTACCACCGATTGAGAGACTTCATATTAATTGCAGCGAGAGCG
GGGGAACTTCTGGGACGCAGCAGTCTCAAGGGACTACGGAGAGGATGGGAAGCCCTTAAGTATCTGGGAAGTCTTGT
GCAGTATTGGGGCCTGGAACTAAAAAGGAGTGCTATTAGTCTATTGGATACCCTAGCAATAGCAGTAGGTGAAGGAA
CAGATAGGATTCTAGAATTTGTATTAGGAATTTGTAGAGCTATCCGCAACATACCTACAAGAATAAGACAGGGCTTT
GAAACAGCTTTGCTATAA
>703016S95.W30.21
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTACCAATGCTACTGCCAGCAATAGCAGTATAATAGAGGGAAATGAAAAATTGCTCTTTCAATATAACCACA
GAATTAAGAGATAAGAGAGAGAAAAAGAATGCACTTTTTTATAAACTTGATATAGTACAACTAGATGGCAACTCTAG
TCAGTATAGATTAATAAAATTGTAATACCTCAGTCATAACACAAGCCTGTCCAAAGGTCTCTTTTGACCCAATTCCTA
TACATTATTGTGCTCCAGCTGGTTATGCGATTCTAAAGTGTAATAATAAGACATTCACTGGAACAGGACCGTGTAAT
AATGTCAGCACAGTACAATGTACACATGGAATTAAGCCAGTGGTTTCAACTCAATTATTGTTAAATGGTAGCCTAGC
AGAAGGAGAGATAATAATTAGATCTGAAAATATAACAAACAATAATAGTACATCTCAATGAATCTG
TAAAGATTGAGTGTACGAGACCCAATAATAAAACAAGAACAAGTATAAGAATAGGACCAGGACAAGCATTTTATGCA
ACAGGACAAGTAATAGGAGACATAAGAGAAGCATATTGTAACATTAGTGAAAGTAAATGGAATGAAACTTTACAAAG
GGTAAGTAAAAAATTAAAAGAATACTTCCCTCATAAGAATATAACATTTCAACCATCCTCAGGAGGGGACCTAGAAA
TTACAACACATAGCTTTAATTGTGGAGGAGAATTTTTCTATTGCAATACATCAAGCCTGTTTAATAGGACATATATG
GCTAATAGTACAGATATGGCTAATAGTACAGAAACTAACAGTACACGAACCATCACAATCCGCTGCAGAATAAAACA
AATTATAAACATGTGGCAGGAGGTGGGACGAGCAATGTATGCCCCTCCCATTGCAGGAAACATAACATGTATATCAA
ATATCACAGGACTACTATTGACAAGGGATGGAGGAGAAAAACAATACGGAGACATTCAGACCTGGAGGAGGAAATATG
AAGGACAATTGGAGAAGTGAATTATATAAATATAAAGTGGTAGAAGTTAAGCCATTAGGAGTAGCACCCACTAATGC
AAGAAGGAGAGTGGTGGAGAGAGAAAAAAGAGCAGTGGGAATGGGAGCTGTGTTCCTTGGGTTCTTGGGAGCGGCAG
GAAGCACTATGGGCGCAGCATCAATAACGCTGACGGTACAGGCCAGACAATTATTGTCTGGTATAGTGCAACAGCAA
AGCAATTTGCTGAAGGCTATAGAGGCTCAACAGCATATGTTGAAACTCACGGTCTGGGGCATTAAACAGCTCCAGGC
AAGAGTCCTGGCCTTGGAAAGATACCTAAAGGATCAACAGCTCCTAGGGATGTGGGCTGCTCTGGAAAAACTCATCT
GCACCACTAATGTATATTGGAACTCTAGTTGGAGTAATAAAACTTATGGTGATATTTGGGATAACATGACCTGGATG
CAGTGGGAGAGAGAAATTAGCAATTATACAGAAATAATATATGAATTGCTTGAAGAATCACAAAACCAGCAGGAAAA
GAATGAACAAGATTTACTAGCATTGGACAGATGGAACAGTCTGTGGAATTGGTTTAACATAACAAATTGGCTGTGGT
ATATAAAAATATTCATAATGATAGTAGGAGGCTTGATAGGTTTAAGAATAATTTTTGCTGTGCTTTCTTTAGTAAAT
AGAGTTAGGCAGGGATACTCACCTCTGTCGTTGCAGACCCTTATCCCAAGCCCGAGGGGACCAGACAGGCCCGGAGG
AATCGAAGAAGAAGGTGGAGAGCAAGACAGAAACAGATCAACGCGATTAGTGAGCGGATTCTTAGCGCTTGTCTGGG
ACGACCTGCGGAGCCTGTGCCTTTTCATCTACCACCGATTGAGAGACTTCATATTAATTGCAGCGAGAGCGGGGGAA
CTTCTGGGACGCAGCAGTCTCAAGGGACTACGGAGAGGATGGGAAGCCCTTAAGTATCTGGGAAGTCTTGTGCAGTA
TTGGGGCCTGGAACTAAAAAGGAGTGCTATTAGTCTATTGGATACCCTAGCAATAGCAGTAGGTGAAGGAACAGATA
GGATTCTAGAATTTGTATTAGGAATTTGTAGAGCTATCCGCAACATACCTACAAGAATAAGACAGGGCTTTGAAACA
GCTTTGCTATAA
>703016S95.W30.18
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAATGCTACTGCCAGCAATAGCAGTATAATAGAGGGAATGAAAAATTGCTCTTTCAATATAACCACA
GAATTAAGAGATAAGAGAGAGAAAAAGAATGCACTTTTTTATAAACTTGATATAGTACAACTAGATGGCAACTCTAG
TCAGTATAGATTAATAAAATTGTAATACCTCAGTCATAACACAAGCCTGTCCAAAGGTCTCTTTTGACCCAATTCCTA
TACATTATTGTGCTCCGGCTGGTTATGCGATTCTAAAGTGTAATAATAAGACATTCACTGGAACAGGACCGTGTAAT
AATGTCAGCACAGTACAATGTACACATGGAATTAAGCCAGTGGTTTCAACTCAACTATTGTTAAATGGTAGCCTAGC
AGAAGGAGAGATAATAATTAGATCTGAAAATATAACAAACAATGCCAAAACAATAATAGTACATCTCAATGAATCTG
TAAAGATTGAGTGTACGAGACCCAATAATAAAACAAGAACAAGTATAAGAATAGGACCAGGACAAGCATTTTATGCA
ACAGGACAAGTAATAGGAGACATAAGAGAAGCATATTGTAACATTAGTGAAAGTAAATGGAATGAAACTTTACAAAG
GGTAAGTAAAAAATTAAAAGAATACTTCCCTCATAAGAATATAACATTTCAACCATCCTCAGGAGGGGACCTAGAAA
TTACAACACATAGCTTTAATTGTGGAGGAGAATTTTTCTATTGCAATACATCAAGCCTGTTTAATAGGACATATATG
GCTAATAGTACAGATATGGCTAATAGTACAGAAACTAACAGTACACGAATCATCACAATCCACTGCAGAATAAAACA
AATTATAAACATGTGGCAGGAGGTGGGACGAGCAATGTATGCCCCTCCCATTGCAGGAAACATAACATGTATATCAA

FIG. 17B cont'd

ATATCACAGGACTACTATTGACAAGGGATGGAGGAAAAAACAATCCGGAGACATTCAGACCTGGAGGAGGAAATATG
AAGGACAATTGGAGAAGTGAATTATATAAATATAAAGTGGTAGAAGTTAAGCCATTAGGAGTAGCACCCACTAATGC
AAGAAGGAGAGTGGTGGAGAGAGAAAAAAGAGCAGTGGGTTTGGGAGCTGTGTTCCTTGGGTTCTTGGGAGCGGCAG
GAAGCACTATGGGCGCAGCATCAATAACGCTGACGGTACAGGCCAGACAATTATTGTCTGGTATAGTGCAACAGCAA
AGCAATTTGCTGAAGGCTATAGAGGCTCAACAGCATATGTTGAAACTCACGGTCTGGGGCATTAAACAGCTCCAGGC
AAGAGTCCTGGCCTTGGAAAGATACCTAAAGGATCAACAGCTCCTAGGGATGTGGGGTTGCTCTGGAAAACTCATCT
GCACCACTAATGTATATTGGAACTCTAGTTGGAGTAATAAAACTTATGGTGATATTTGGGATAACATGACCTGGATG
CAGTGGGAGAGAGAAATTAGCAATTATACAGAAATAATATATGAATTGCTTGAAGAATCACAAAACCAGCAGGAAAA
GAATGAACAAGATTTACTAGCATTGGACAGATGGAACAGTCTGTGGAATTGGTTTAACATAACAAATTGGCTGTGGT
ATATAAAAATATTCATAATGATAGTAGGAGGCTTGATAGGTTTAAGAATAATTTTTGCTGTGCTTTCTTTAGTAAAT
AGAGTTAGGCAGGGATACTCACCTCTGTCGTTGCAGACCCTTATCCCAAGCCCGAGGGGACCAGACAGGCCCGGAGG
AATCGAAGAAGAAGGTGGAGAGCAAGACAGAAACAGATCAACGCGATTAGTGAGCGGATTCTTAGCGCTTGTCTGGG
ACGACCTGCGGAGCCTGTGCCTTTTCATCTACCACCGATTGAGAGACTTCATATTAATTGCAGCGAGAGCGGGGGAA
CTTCTGGGACGCAGCAGTCTCAAGGGACTACGGAGAGGATGGGAAGCCCTTAAGTATCTGGGAAGTCTTGTGCAGTA
TTGGGGCCTGGAACTAAAAAGGAGTGCTATTAGTCTATTGGATACCCTAGCAATAGTAGTAGGTGAAGGAACAGATA
GGATTCTAGAATTTGTATTAGGAATTTGTAGAGCTATCCGCAACATACCTACAAGAATAAGACAGGGCTTTGAAACA
GCTTTGCTATAA
>703010505.W30.24
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCCCTCTGTGTCACTCTAAACTGTACCA
ATGCTACTGCCAATGCTACTGCCAGCAATAGCAGTATAATAGAGGGAATGAAAAATTGCTCTTTCAATATAACCACA
GAATTAAGAGATAAGAGAGAGAAAAAGAATGCACTTTTTTATAAACTTGATATAGTACAACTAGATGGCAACTCTAG
TCAGTATAGATTAATAAATTGTAATACCTCAGTCATAACACAAGCCTGTCCAAAGGTCTCTTTTGACCCAATTCCTA
TACATTATTGTGCTCGGTTATGCGATTCTAAAGTGTAATAATAAGACATTCAATGGAACAGGACCGTGTAAT
AATGTCAGCACAGTACAATGTACACATGGAATTAAGCCAGTGGTTTCAACTCAACTATTGTTAAATGGTAGCCTAGC
AGAAGGAGAGATAATAATTAGATCTGAAAATATAACAAACAATGTCAAAACAATAATAGTACATCTCAATGAATCTG
TAAAGATTGAGTGTACGAGACCCAATAATAAAACAAGAACAAGTATAAGAATAGGACCAGGACAAGCATTTTATGCA
ACAGGACAAGTAATAGGAGACATAAGAGAAGCAYATTGTAACATTAGTGAAAGTAAATGGAATGAAACTTTACAAAG
GGTAAGTAAAAATTAAAAGAATACTTCCCTCATAAGAATATAACATTTCAACCATCCTCAGGAGGGGACCTAGAAA
TTACAACACATAGCTTTAATTGTGGAGGAGAATTTTTCTATTGCAATACATCAAGCCTGTTTAATAGGACATATATG
GCTAATAGTACAGATATGGCTAATAGTACAGAAACTAACAGTACACGAACCATCAMAMTCCACTGCAGAATAAAACA
AATTATAAACATGTGGCAGGAGGTGGGACGAGCAATGTATGCCCCTCCCATTGCAGGAAACATAACATGTATATCAA
ATATCACAGGACTACTATTGACAAGGGATGGAGGAAAAAACAATACGGAGACATTCAGACCTGGAGGAGGAAATATG
AAGGACAATTGGAGAAGTGAATTATATAAATATAAAGTGGTAGAAGTTAAGCCATTAGGAGTAGCACCCACTAATGC
AAGAAGGAGAGTGGTGGAGAGAGAAAAAAGAGCAGTGGGAATGGGAGCTGTGTTCCTTGGGTTCTTGGGAGCGGCAG
GAAGCACTATGGGCGCAGCATCAATAACGCTGACGGTACAGGCCAGACAATTATTGTCTGGTATAGTGCAACAGCAA
AGCAATTTGCTGAAGGCTATAGAGGCTCAACAGCATATGTTGAAACTCACGGTCTGGGGCATTAAACAGCTCCAGGC
AAGAGTCCTGGCCTTGGAAAGATACCTAAAGGATCAACAGCTCCTAGGGATGTGGGGCTGCTCTGGAAAACTCATCT
GCACCACTAATGTATATTGGAACTCTAGTTGGAGTAATAAAACTTATGGTGATATTTGGGATAACATGACCTGGATG
CAGTGGGAGAGAGAAATTAGCAATTATACAGAAATAATATATGAATTGCTTGAAGAATCACAAAACCAGCAGGAAAA
GAATGAACAAGATTTACTAGCATTGGACAGATGGAACAGTCTGTGGAATTGGTTTAACATAACAAATTGGCTGTGGT
ATATAAAAATATTCATAATGATAGTAGGAGGCTTGATAGGTTTAAGAATAATTTTTGCTGTGCTTTCTTTAGTAAAT
AGAGTTAGGCAGGGATACTCACCTCTGTCGTTGCAGACCCTTATCCCAAGCCCGAGGGGACCAGACAGGCCCGGAGG
AATCGAAGAAGAAGGTGGAGAGCAAGACAGAAACAGATCAACGCGATTAGTGAGCGGATTCTTAGCGCTTGTCTGGG
ACGACCTGCGGAGCCTGTGCCTTTTCATCTACCACCGATTGAGAGACTTCATATTAATTGCAGCGAGAGCGGGGGAA
CTTCTGGGACGCAGCAGTCTCAAGGGACTACGGAGAGGATGGGAAGCCCTTAAGTATCTGGGAAGTCTTGTGCAGTA
TTGGGGCCTGGAACTAAAAAGGAGTGCTATTAGTCTATTGGATACCCTAGCAATAGCAGTAGGTGAAGGAACAGATA
GGATTCTAGAATTTGTATTAGGAATTTGTAGAGCTATCCGCAACATACCTACAAGAATAAGACAGGGCTTTGAAACA
GCTTTGCTATAA
>703010505.W30.9
ATGAGAGTAATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCCCTCTGTGTCACTCTAAACTGTACCA
ATGCTACTGCCAATGCTACTGCCAGCAATAGCAGTATAATAGAGGGAATGAAAAATTGCTCTTTCAATATAACCACA
GAATTAAGAGATAAGAGAGAGAAAAAGAATGCACTTTTTTATAAACTTGATATAGTACAACTAGATGGCAACTCTAG
TCAGTATAGATTAATAAATTGTAATACCTCAGTCATAACACAAGCCTGTCCAAAGGTCTCTTTTGACCCAATTCCTA
TACATTATTGTGCTCCAGCTGGTTATGCGATTCTAAAGTGTAATAATAAGACATTCAATGGAACAGGACCGTGTAAT
AATGTTAGCACAGTACAATGTACACATGGAATTAAGCCAGTGGTTTCAACTCAACTATTGTTAAATGGTAGCCTAGC
AGAAGGAGAGATAATAATTAGATCTGAAAATATAACAAACAATGTCAAAACAATAATAGTACATCTCAATGAATCTG
TAAAGATTGAGTGTACGAGACCCAATAATAAAACAAGAACAAGTATAAGAATAGGACCAGGACAAGCATTTTATGCA
ACAGGACAAGTAATAGGAGACATAAGAGAAGCACATTGTAACATTAGTGAAAGTAAATGGAATAAAACTTTACAAAG
GGTAAGTAAAAATTAAAAGAATACTTCCCTCATAAGAATATAACATTTCAACCATCCTCAGGAGGGGACCTAGAAA
TTACAACACATAGCTTTAATTGTGGAGGAGAATTTTTTCTATTGCAATACATCAAGCCTGTTTAATAGGACATATATG
GCTAATAGTACAGATATGGCTAATAGTACAGAAACTAACAGTACACGAACCATCACAATCCGCTGCAGAATAAAACA
AATTATAAACATGTGGCAGGAGGTGGGACGAGCAATGTATGCCCCTCCCATTGCAGGAAACATAACATGTATATCAA

FIG. 17B cont'd

ATATCACAGGACTACTATTGACAAGGGATGGAGGAAAAAACAATACGGATACGGAGACATTCAGACCTGGAGGAGGA
AATATGAAGGACAATTGGAGAAGTGAATTATATAAATATAAAGTGGTAGAAGTTAAGCCATTAGGAGTAGCACCCAC
TAATGCAAGAAGGAGAGTGGTGGAGAGAGAAAAAAGAGCAGTGGGAATGGGAGCTGTGTTCCTTGGGTTCTTGGGAG
CGGCAGGAAGCACTATGGGCGCAGCATCAATAACGCTGACGGTACAGGCCAGACAATTATTGTCTGGTATAGTGCAA
CAGCAAAGCAATTTGCTGAAGGCTATAGAGGCTCAACAGCATATGTTGAAACTCACGGTCTGGGGCATTAAACAGCT
CCAGGCAAGAGTCCTGGCCTTGGAAAGATACCTAAAGGATCAACAGCTCCTAGGGATGTGGGGCTGCTCTGGAAAAC
TCATCTGCACCACTAATGTATATTGGAACTCTAGTTGGAGTAATAAAACTTATGGTGATATTTGGGATAACATGACC
TGGATGCAGTGGGAGAGAGAAATTAGCAATTATACAGAAATAATATATGAATTGCTTGAAGAATCACAAAACCAGCA
GGAAAAGAATGAACAAGATTTACTAGCATTGGACAGATGGAACAGTCTGTGGAATTGGTTTAACATAACAAATTGGC
TGTGGTATATAAAAATATTCATAATGATAGTAGGAGGCTTGATAGGTTTAAGAATAATTTTTGCTGTGCTTTCTTTA
GTAAATAGAGTTAGGCAGGGATACTCACCTCTGTCGTTACAGACCCTTATCCCAAGCCCGAGGGGACCAGACAGGCC
CGGAGGAATCGAAGAAGAAGGTGGAGAGCAAGACAGAAACAGATCAACGCGATTAGTGAGCGGATTCTTAGCGCTTG
TCTGGGACGACCTGCGGAGCCTGTGCCTTTTCATCTACCACCGATTGAGAGACTTCATATTAATTGCAGCGAGAGCG
GGGGAACTTCTGGGACGCAGCAGTCTCAAGGGACTACGGAGAAGATGGGAAGCCCTTAAGTATCTGGGAAGTCTTGT
GCAGTATTGGGGCCTGGAACTAAAAAGGAGTGCTATTAGTCTATTGGATACCCTAGCAATAGCAATAGGTGAAGGAA
CAGATAGGATTCTAGAATTTGTATTAGGAATTTGTAGAGCTATCCGCAACATACCTACAAGAATAAGACAGGGCTTT
GAAACAGCTTTGCTATAA
>703016905.W30.36
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCCCTCTGTGTCACTCTAAACTGTACCA
ATGCTACTGCCAATGCTACTGCCAGCAATAGCAGTATAATAGAGGGAATGAAAAATTGCTCTTTCAATATAACCACA
GAATTAAGAGATAAGAGAGAGAAAAAGAATGCACTTTTTTATAAACTTGATATAGTACAACTAGATGGCAACTCTAG
TCAGTATAGATTAATAAATTGTAATACCTCAGTCATAACACAAGCCTGTCCAAAGGTCTCTTTTGACCCAATTCCTA
TACATTATTGTGCTCCAGCTGGTTATGCGATTCTAAAGTGTAATAATAAGACATTCAATGGAACAGGACCGTGTAAT
AATGTCAGCACAGTACAATGTACACATGGAATTAAGCCAGTGGTTTCAACTCAACTATTGTTAAATGGTAGCCTAGC
AGAAGGAGAGATAATAATTAGATCTGAAAATATAACAAACAATGTCAAAACAATAATAGTACATCTCAATGAATCTG
TAAAGATTGAGTGTACGAGACCCAATAATAAAACAAGAACAAGTATAAGAATAGGACCAGGACAAGCATTTTATGCA
ACAGGACAAGTAATAGGAGATAAGAGAAAGCATATTGTAACATTAGTGAAAGTAAATGGAATGAAACTTTACAAAG
GGTAAGTAAAAAATTAAAAGAATACTTCCCTCATAAGAATATAACATTTCAACCATCCTCAGGAGGGGACCTAGAAA
TTACAACACATAGCTTTAATTGTGGAGGAGAATTTTTCTATTGCAATACATCAAGCCTGTTTAATAGGACATATATG
GCTAATAGTACAGATATGGCTAATAGTACAGAAACTAACAGTACACGAACCATCAAAATCCACTGCAGAATAAAACA
AATTATAAACATGTGGCAGGAGGTGGGACGAGCAATGTATGCCCCTCCCATTGCAGGAAACATAACATGTATATCAA
ATATCACAGGACTACTATTGACAAGGGATGGAGGAAAAAACAATACGGATACGGAGACATTCAGACCTGGAGGAGGA
AATATGAAGGACAATTGGAGAAGTGAATTATATAAATATAAAGTGGTAGAAGTTAAGCCATTAGGAGTAGCACCCAC
TAATGCAAGAAGGAGAGTGGTGGAGAGAGAAAAAAGAGCAGTGGGAATGGGAGCTGTGTTCCTTGGGTTCTTGGGAG
CGGCAGGAAGCACTATGGGCGCAGCATCAATAACGCTGACGGTACAGGCCAGACAATTATTGTCTGGTATAGTGCAA
CAGCAAAGCAATTTGCTGAAGGCTATAGAGGCTCAACAGCATATGTTGAAACTCACGGTCTGGGGCATTAAACAGCT
CCAGGCAAGAGTCCTGGCCTTGGAAAGATACCTAAAGGATCAACAGCTCCTAGGGATGTGGGGCTGCTCTGGAAAAC
TCATCTGCACCACTAATGTATATTGGAACTCTAGTTGGAGTAATAAAACTTATGGTGATATTTGGGATAACATGACC
TGGATGCAGTGGGAGAGAGAAATTAGCAATTATACAGAAATAATATATGAATTGCTTGAAGAATCACAAAACCAGCA
GGAAAAGAATGAACAAGATTTACTAGCATTGGACAGATGGAACAGTCTGTGGAATTGGCTTAACATAACAAATTGGC
TGTGGTATATAAAAATATTCATAATGATAGTAGGAGGCTTGATAGGTTTAAGAATAATTTTTGCTGTGCTTTCTTTA
GTAAATAGAGTTAGGCAGGGATACTCACCTCTGTCGTTACAGACCCTTATCCCAAGCCCGAGGGGACCAGACAGGCC
CGGAGGAATCGAAGAAGAAGGTGGAGAGCAAGACAGAAACAGATCAACGCGATTAGTGAGCGGATTCTTAGCGCTTG
TCTGGGACGACCTGCGGAGCCTGTGCCTTTTCATCTACCACCGATTGAGAGACTTCATATTAATTGCAGCGAGAGCG
GGGGAACTTCTGGGACGCAGCAGTCTCAAGGGACTACGGAGAGGATGGAAGCCCTTAAGTATCTGGGAAGTCTTGT
GCAGTATTGGGGCCTGGAACTAAAAAGGAGTGCTATTAGTCTATTGGATACCCTAGCAATAGCAGTAGGTGAAGGAA
CAGATAGGATTCTAGAATTTGTATTAGGAATTTGTAGAGCTATCCGCAACATACCTACAAGAATAAGACAGGGCTTT
GAAACAGCTTTGCTATAA
>703016905.W30.5
ATGAGAGTGATGGGGATACAGAGGAATTATCCACAATGGTGGATATGGAGCATGTTAGGCTTTTGGATGCTAATGAT
TTGTAACGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAATGCTACTGCCAGCAATAGCAGTATAATAGAGGGAATGAAAAATTGCTCTTTCAATATAACCACA
GAATTAAGAGATAAGAGAGAGAAAAAGAATGCACTTTTTTATAAACTTGATATAGTACAACTAGATGGCAACTCTAG
TCAGTATAGATTAATAAATTGTAATACCTCAGTCATAACACAAGCCTGTCCAAAGGTCTCTTTTGACCCAATTCCTA
TACATTATTGTGCTCCAGCTGGTTATGCGATTCTAAAGTGTAATAATAAGACATTCACTGGAACAGGACCGTGTAAT
AATGTCAGCACAGTACAATGTACACATGGAATTAAGCCAGTGGTTTCAACTCAACTATTGTTAAATGGTAGCCTAGC
AGAAGGAGAGATAATAATTAGATCTGAAAATATAACAAACAATGTCAAAACAATAATAGTACAATCTCAATGAATCTG
TAAAGATTGAGTGTACGAGACCCAATAATAAAACAAGAACAAGTATAAGAATAGGACCAGGACAAGCATTTTATGCA
ACAGGACAAGTAATAGGAAACATAAGAGAAGCATATTGTAACATTAGTGAAAGTAAATGGAATGAAACTTTACAAAG
GGTAAGTAAAAAATTAAAAGAATACTTCCCTCATAAGAATATAACATTTCAACCATCCTCAGGAGGGGACCTAGAAA
TTACAACACATAGCTTTAATTGTGGAGGAGAATTTTTCTATTGCAATACATCAAGCCTGTTTAATAGGACATATATG
GCTAATAGTACAGATATGGCTAATAGTACAGAAACTAACAGTACACGAATCATCACAATCCACTGCAGAATAAAACA
AATTATAAACATGTGGCAGGAGGTGGGACGAGCAATGTATGCCCCTCCCATTGCAGGAAACATAACATGTATATCAA

FIG. 17B cont'd

```
ATATCACAGGACTACTATTGACAAGGGATGGAGGAAAAAACAATACGGATACGGAGACATTCAGACCTGGAGGAGGA
AATATGAAGGACAATTGGAGAAGTGAATTATATAAATATAAAGTGGTAGAAGTTAAGCCATTAGGAGTAGCACCCAC
TAATGCAAGAAGGAGAGTGGTGGAGAGAGAAAAAAGAGCAGTGGGAATGGGAGCTGTGTTCCTTGGGTTCTTGGGAG
CGGCAGGAAGCACTATGGGCGCAGCATCAATAACGCTGACGGTACAGGCCAGACAATTATTGTCTGGTATAGTGCAA
CAGCAAAGCAATTTGCTGAAGGCTATAGAGGCTCAACAGCATATGTTGAAACTCACGGTCTGGGGCATTAAACAGCT
CCAGGCAAGAGTCCTGGCCTTGGAAAGATACCTAAAGGATCAACAGCTCCTAGGGATGTGGGGCTGCTCTGGAAAAC
TCATCTGCACCACTAATGTATATTGGAACTCTAGTTGGAGTAATAAAACTTATGGTGATATTTGGGATAACATGACC
TGGATGCAGTGGGAGAGAGAAATTAGCAATTATACAGAAATAATATATGAATTGCTTGAAGAATCACAAAACCAGCA
GGAAAAGAATGAACAAGATTTACTAGCATTGGACAGATGGAACAGTCTGTGGAATTGGTTTAACATAACAAATTGGC
TGTGGTATATAAAAATATTCATAATGATAGTAGGAGGCTTGATAGGTTTAAGAATAATTTTTGCTGTGCTTTCTTTA
GTAAATAGAGTTAGGCAGGGATACTCACCTCTGTCGTTGCAGACCCTTATCCCAAGCCCGAGGGGACCAGACAGGCC
CGGAGGAATCGAAGAAGAAGGTGGAGAGCAAGACAGAAACAGATCAACGCGATTAGTGAGCGGATTCTTAGCGCTTG
TCTGGGACGACCTGCGGAGCCTGTGCCTTTTCATCTACCACCGATTGAGAGACTTCATATTAATTGCAGCGAGAGCG
GGGGAACTTCTGGGACGCAGCAGTCTCAAGGGACTACGGAGAGGATGGGAAGCCCTTAAGTATCTGGGAAGTCTTGT
GCAGTATTGGGGCCTGGAACTAAAAAGGAGTGCTATTAGTCTATTGGATACCCTAGCAATAGCAGTAGGTGAAGGAA
CAGATAGGATTCTAGAATTTGTATTAGGAATTTGTAGAGCTATCCGCAACATACCTACAAGAATAAGACAGGGCTTT
GAAACAGCTTTGCTATAA
>703010505.W30.37
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATGCTACTGCCAGCAATAGCAGTATAATAGAGGGAATGAAAAATTGCTCTTTCAATATAACC
ACAGAATTAAGAGATAAGAGAGAGAAAAAGAATGCACTTTTTTATAAACTTGATATAGTACAACTAGATGGCAACTC
TAGTCAGTATAGATTAATAAATTGTAATACCTCAGTCATAACACAAGCCTGTCCAAAGGTCTCTTTTGACCCAATTC
CTATACATTATTGTGCTCCAGCTGGTTATGCGATTCTAAAGTGTAATAATAAGACATTCACTGGAACAGGACCGTGT
AATAATGTCAGCACAGTACAATGTACACATGGAATTAAGCCAGTGGTTTCAACTCAACTATTGTTAAATGGTAGCCT
AGCAGAAGGAGAGATAATAATTAGATCTGAAAATATAACAAACAATGTCAAAACAATAATAGTACATCTCAATGAAT
CTGTAAAGATTGAGTGTACGAGACCCAATAATAAAACAAGAACAAGTATAAGAATAGGACCAGGACAAGCATTTTAT
GCAACAGGACAAGTAATAGGA3AAACATAAGAGAAAGTATTGTAACATTAGTGAAAGTAAATGGAATGAAACTTTACA
AAGGGTAAGTAAAAAATTAAAAGAATACTTCCCTCATAAGAATATAACATTTCAACCATCCTCAGGAGGGGACCTAG
AAATTACAACACATAGCTTTAATTGTGGAGGAGAATTTTTTCTATTGCAATACATCAAGCCTGTTTAATAGGACATAT
ATGGCTAATAGTACAGATATGGCTAATAGTACAGAAACTAACAGTACACGAATCATCACAATCCACTGCAGAATAAA
ACAAATTATAAACATGTGGCAGGAGGTGGGACGAGCAATGTATGCCCCTCCCATTGCAGGAAACATAACATGTATAT
CAAATATCACAGGACTACTATTGACAAGGGATGGAGGAAAAACAATACGGATACGGAGACATTCAGACCTGGAGGA
GGAAATATGAAGGACAATTGGAGAAGTGAATTATATAAATATAAAGTGGTAGAAGTTAAGCCATTAGGAGTAGCACC
CACTAATGCAAGAAGGAGAGTGGTGGAGAGAGAAAAAAGAGCAGTGGGAATGGGAGCTGTGTTCCTTGGGTTCTTGG
GAGCGGCAGGAAGCACTATGGGCGCAGCATCAATAACGCTGACGGTACAGGCCAGACAATTATTGTCTGGTATAGTG
CAACAGCAAAGCAATTTGCTGAAGGCTATAGAGGCTCAACAGCATATGTTGAAACTCACGGTCTGGGGCATTAAACA
GCTCCAGGCAAGAGTCCTGGCCTTGGAAAGATACCTAAAGGATCAACAGCTCCTAGGGATGTGGGGCTGCTCTGGAA
AACTCATCTGCACCACTAATGTATATTGGAACTCTAGTTGGAGTAATAAAACTTATGGTGATATTTGGGATAACATG
ACCTGGATGCAGTGGGAGAGAGAAATTAGCAATTATACAGAAATAATATATGAATTGCTTGAAGAATCACAAAACCA
GCAGGAAAAGAATGAACAAGATTTACTAGCATTGGACAGATGGAACAGTCTGTGGAATTGGTTTAACATAACAAATT
GGCTGTGGTATATAAAAATATTCATAATGATAGTAGGAGGCTTGATAGGTTTAAGAATAATTTTTGCTGTGCTTTCT
TTAGTAAATAGAGTTAGGCAGGGATACTCACCTCTGTCGTTACAGACCCTTATCCCAAGCCCGAGGGGACCAGACAG
GCCCGGAGGAATCGAAGAAGAAGGTGGAGAGCAAGACAGAAACAGATCAACGCGATTAGTGAGCGGATTCTTAGCGC
TTGTCTGGGACGACCTGCGGAGCCTGTGCCTTTTCATCTACCACCGATTGAGAGACTTCATATTAATTGCAGCGAGA
GCGGGGGAACTTCTGGGACGCAGCAGTCTCAAGGGACTACGGAGAGGATGGGAAGCCCTTAAGTATCTGGGAAGTCT
TGTGCAGTATTGGGGCCTGGAACTAAAAAGGAGTGCTATTAGTCTATTGGATACCCTAGCAATAGCAGTAGGTGAAG
GAACAGATAGGATTCTAGAATTTGTATTAGGAATTTGTAGAGCTATCCGCAACATACCTACAAGAATAAGACAGGGC
TTTGAAACAGCTTTGCTATAA
>703010505.W30.27
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATGCTACTGCCAGCAATAGCAGTATAATAGAGGGAATGAAAAATTGCTCTTTCAATATAACC
ACAGAATTAAGAGATAAGAGAGAGAAAAAGAATGCACTTTTTTATAAACTTGATATAGTACAACTAGATGGCAACTC
TAGTCAGTATAGATTAATAAATTGTAATACCTCAGTCATAACACAAGCCTGTCCAAAGGTCTCTTTTGACCCAATTC
CTATACATTATTGTGCTCCAGCTGGTTATGCGATTCTAAAGTGTAATAATAAGACATTCACTGGAACAGGACCGTGT
AATAATGTCAGCACAGTACAATGTACACATGGAATTAAGCCAGTGGTTTCAACTCAACTATTGTTAAATGGTAGCCT
AGCAGAAGGAGAGATAATAATTAGATCTGAAAATATAACAAACAATGTCAAAACAATAATAGTACATCTCAATGAAT
CTGTAAAGATTGAGTGTACGAGACCCAATAATAAAACAAGAACAAGTATAAGAATAGGACCAGGACAAGCATTTTAT
GCAACAGGACAAGTAATAGGAAACATAAGAGAAGCATATTGTAACATTAGTGAAAGTAAATGGAATGAAACTTTACA
AAGGGTAAGTAAAAAATTAAAAGAATACTTCCCTCATAAGAATATAACATTTCAACCATCCTCAGGAGGGGACCTAG
AAATTACAACACATAGCTTTAATTGTGGAGGAGAATTTTTTCTATTGCAATACATCAAGCCTGTTTAATAGGACATAT
ATGGCTAATAGTACAGATATGGCTAATAGTACAGAAACTAACAGTACACGAATCATCACAATCCACTGCAGAATAAA
ACAAATTATAAACATGTGGCAGGAGGTGGGACGAGCAATGTATGCCCCTCCCATTGCAGGAAACATAACATGTATAT
```

FIG. 17B cont'd

```
CAAATATCACAGGACTACTATTGACAAGGGATGGAGGAAAAAACAATACGGATACGGAGACATTCAGACCTGGAGGA
GGAAATATGAAGGACAATTGGAGAAGTGAATTATATAAATATAAAGTGGTAGAAGTTAAGCCATTAGGAGTAGCACC
CACTAATGCAAGAAGGAGAGTGGTGGAGAGAGAAAAAAGAGCAGTGGGAATGGGAGCTGTGTTCCTTGGGTTCTTGG
GAGCGGCAGGAAGCACTATGGGCGCAGCATCAATAACGCTGACGGTACAGGCCAGACAATTATTGTCTGGTATAGTG
CAACAGCAAAGCAATTTGCTGAAGGCTATAGAGGCTCAACAGCATATGTTGAAACTCACGGTCTGGGGCATTAAACA
GCTCCAGGCAAGAGTCCTGGCCTTGGAAAGATACCTAAAGGATCAACAGCTCCTAGGGATGTGGGGCTGCTCTGGAA
AACTCATCTGCACCACTAATGTATATTGGAACTCTAGTTGGAGTAATAAAACTTATGGTGATATTTGGGATAACATG
ACCTGGATGCAGTGGGAGAGAGAAATTAGCAATTATACAGAAATAATATATGAATTGCTTGAAGAATCACAAAACCA
GCAGGAAAAGAATGAACAAGATTTACTAGCATTGGACAGATGGAACAGTCTGTGGAATTGGTTTAACATAACAAATT
GGCTGTGGTATATAAAAATATTCATAATGATAGTAGGAGGCTTGATAGGTTTAAGAATAATTTTTGCTGTGCTTTCT
TTAGTAAATAGAGTTAGGCAGGGATACTCACCTCTGTCGTTACAGACCCTTATCCCAAGCCCGAGGGGACCAGACAG
GCCCGGAGGAATCGAAGAAGAAGGTGGAGAGCAAGACAGAAACAGATCAACGCGATTAGTGAGCGGATTCTTAGCGC
TTGTCTGGGACGACCTGCGGAGCCTGTGCCTTTTCATCTACCACCGATTGAGAGACTTCATATTAATTGCAGCGAGA
GCGGGGGAACTTCTGGGACGCAGCAGTCTCAAGGGACTACGGAGAGGATGGGAAGCCCTTAAGTATCTGGGAAGTCT
TGTGCAGTATTGGGGCCTGGAACTAAAAAGGAGTGCTATTAGTCTATTGGATACCCTAGCAATAGCAGTAGGTGAAG
GAACAGATAGGATTCTAGAATTTGTATTAGGAATTTGTAGAGCTATCCGCAACATACCTACAAGAATAAGACAGGGC
TTTGAAACAGCTTTGCTATAA
>703016S05.W30.34
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATGCTACTGCCAGCAATAGCAGTATAATAGAGGGAATGAAAAATTGCTCTTTCAATATAACC
ACAGAATTAAGAGATAAGAGAGAGAAAAAGAATGCACTTTTTTATAAACTTGATATAGTACAACTAGATGGCAACTC
TAGTCAGTATAGATTAATAAATTGTAATACCTCAGTCATAACACAAGCCTGTCCAAAGGTCTCTTTTGACCCAATTC
CTATACATTATTGTGCTCCAGCTGGTTATGCGATTCTAAAGTGTAATAATAAGACATTCACTGGAACAGGACCGTGT
AATAATGTCAGCACAGTACAATGTACACATGGAATTAAGCCAGTGGTTTCAACTCAACTATTGTTAAATGGTAGCCT
AGCAGAAGGAGAGATAATAATTAGATCTGAAAATATAACAAACAATGTCAAAACAATAATAGTACATCTCAATGAAT
CTGTAAAGATTGAGTGTACGAGACCCAATAATAAAACAAGAACAAGTATAAGAATAGGACCAGGACAAGCATTTTAT
GCAACAGGACAAGTAATAGGAAACATAAGAGAAGCATATTGTAACATTAGTGAAAGTAAATGGAATGAAACTTTACA
AAGGGTAAGTAAAAAATTAAAAGAATACTTCCCTCATAAGAATATAACATTTCAACCATCCTCAGGAGGGGACCTAG
AAATTACAACACATAGCTTTAATTGTGGAGGAGAATTTTTCTATTGCAATACATCAAGCCTGTTTAATAGGACATAT
ATGGCTAATAGTACAGATATGGCTAATAGTACAGAAACTAACAGTACACGAACCATCACAATCCCCTGCAGAATAAA
ACAAATTATAAACATGTGGCAGGAGGTGGGACGAGCAATGTATGCCCCTCCCATTGCAGGAAACATAACATGTATAT
CAAATATCACAGGACTACTATTGACAAGGGATGGAGGAAAAAACAATACGGATACGGAGACATTCAGACCTGGAGGA
GGAAATATGAAGGACAATTGGAGAAGTGAATTATATAAATATAAAGTGGTAGAAGTTAAGCCATTAGGAGTAGCACC
CACTAATGCAAGAAGGAGAGTGGTGGAGAGAGAAAAAAGAGCAGTGGGAATGGGAGCTGTGTTCCTTGGGTTCTTGG
GAGCGGCAGGAAGCACTATGGGCGCAGCATCAATAACGCTGACGGTACAGGCCAGACAATTATTGTCTGGTATAGTG
CAACAGCAAAGCAATTTGCTGAAGGCTATAGAGGCTCAACAGCATATGTTGAAACTCACGGTCTGGGGCATTAAACA
GCTCCAGGCAAGAGTCCTGGCCTTGGAAAGATACCTAAAGGATCAACAGCTCCTAGGGATGTGGGGCTGCTCTGGAA
AACTCATCTGCACCACTAATGTATATTGGAACTCTAGTTGGAGTAATAAAACTTATGGTGATATTTGGGATAACATG
ACCTGGATGCAGTGGGAGAGAGAAATTAGCAATTATACAGAAATAATATATGAATTGCTTGAAGAATCACAAAACCA
GCAGGAAAAGAATGAACAAGATTTACTAGCATTGGACAGATGGAACAGTCTGTGGAATTGGTTTAACATAACAAATT
GGCTGTGGTATATAAAAATATTCATAATGATAGTAGGAGGCTTAATAGGTTTAAGAATAATTTTTGCTGTGCTTTCT
TTAGTAAATAGAGTTAGGCAGGGATACTCACCTCTGTCGTTGCAGACCCTTATCCCAAGCCCGAGGGGACCAGACAG
GCCCGGAGGAATCGAAGAAGAAGGTGGAGAGCAAGACAGAAACAGATCAACGCGATTAGTGAGCGGATTCTTAGCGC
TTGTCTGGGACGACCTGCGGAGCCTGTGCCTTTTCATCTACCACCGATTGAGAGACTTCATATTAATTGCAGCGAGA
GCGGGGGAACTTCTGGGACGCAGCAGTCTCAAGGGACTACGGAGAGGATGGGAAGCCCTTAAGTATCTGGGAAGTCT
TGTGCAGTATTGGGGCCTGGAACTAAAAAGGAGTGCTATTAGTCTATTGGATACCCTAGCAATAGCAGTAGGTGAAG
GAACAGATAGGATTCTAAAATTTGTATTAGGAATTTGTAGAGCTATCCGCAACATACCTACAAGAATAAGACAGGGC
TTTGAAACAGCTTTGCTATAA
>703016S05.W30.23
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATGCTACTGCCAGCAATAGCAGTATAATAGAGGGAATGAAAAATTGCTCTTTCAATATAACC
ACAGAATTAAGAGATAAGAGAGAGAAAAAGAATGCACTTTTTTATAAACTTGATATAGTACAACTAGATGGCAACTC
TAGTCAGTATAGATTAATAAATTGTAATACCTCAGTCATAACACAAGCCTGTCCAAAGGTCTCTTTTGACCCAATTC
CTATACATTATTGTGCTCCAGCTGGTTATGCGATTCTAAAGTGTAATAATAAGACATTCACTGGAACAGGACCGTGT
AATAATGTCAGCACAGTACAATGTACACATGGAATTAAGCCAGTGGTTTCAACTCAACTATTGTTAAATGGTAGCCT
AGCAGAAGGAGAGATAATAATTAGATCTGAAAATATAACAAACAATGGCAAAACAATAATAGTACATCTCAATGAAT
CTGTAAAGATTGAGTGTACGAGACCCAATAATAAAACAAGAACAAGTATAAGAATAGGACCAGGACAAGCATTTTAT
GCAACAGGACAAGTAATAGGAAACATAAGAGAAGCACATTGTAACATTAGTGAAAGTAAATGGAATGAAACTTTACA
AAGGGTAAGTAAAAAATTAAAAGAATACTTCCCTCATAAGAATATAACATTTCAACCATCCTCAGGAGGGGACCTAG
AAATTACAACACATAGCTTTAATTGTGGAGGAGAATTTTTCTATTGCAATACATCAAGCCTGTTTAATAGGACATAT
ATGGCTAATAGTACAGATATGGCTAATAGTACAGAAACTAACAGTACACGAACCATCACACTCCACTGCAGAATAAA
ACAAATTATAAACATGTGGCAGGAGGTGGGACGAGCAATGTATGCCCCTCCCATTGCAGGAAACATAACATGTATAT
```

FIG. 17B cont'd

```
CAAATATCACAGGACTACTATTGACAAGGGATGGAGGAAAAAACAATACGGATACGGAGACATTCAGACCTGGAGGA
GGAAATATGAAGGACAATTGGAGAAGTGAATTATATAAATATAAAGTGGTAGAAGTTAAGCCATTAGGAGTAGCACC
CACTAATGCAAGAAGGAGAGTGGTGGAGAGAGAAAAAAGAGCAGTGGGAATGGGAGCTGTGTTCCTTGGGTTCTTGG
GAGCGGCAGGAAGCACTATGGGCGCAGCATCAATAACGCTGACGGTACAGGCCAGACAATTATTGTCTGGTATAGTG
CAACAGCAAAGCAATTTGCTGAAGGCTATAGAGGCTCAACAGCATATGTTGAAACTCACGGTCTGGGGCATTAAACA
GCTCCAGGCAAGAGTCCTGGCCTTGGAAAGATACCTAAAGGATCAACAGCTCCTAGGGATGTGGGGCTGCTCTGGAA
AACTCATCTGCACCACTAATGTATATTGGAACTCTAGTTGGAGTAATAAAACTTATGGTGATATTTGGGATAACATG
ACCTGGATGCAGTGGGAGAGAGAAATTAGCAATTATACAGAAATAATATATGAATTGCTTGAAGAATCACAAAACCA
GCAGGAAAAGAATGAACAAGATTTACTAGCATTGGACAGATGGAACAGTCTGTGGAATTGGTTTAACATAACAAATT
GGCTGTGGTATATAAAAATATTCATAATGATAGTAGGAGGCTTGATAGGTTTAAGAATAATTTTTGCTGTGCTTTCT
TTAGTAAATAGAGTTAGGCAGGGATACTCACCTCTGTCGTTACAGACCCTTATCCCAAGCCCGAGGGGACCAGACAG
GCCCGGAGGAATCGAAGAAGAAGGTGGAGAGCAAGACAGAAACAGATCAACGCGATTAGTGAGCGGATTCTTAGCGC
TTGTCTGGGACGACCTGCGGAGCCTGTGCCTTTTCATCTACCACCGATTGAGAGACTTCATATTAATTGCAGCGAGA
GCGGGGGAACTTCTGGGACGCAGCAGTCTCAAGGGACTACGGAGAGGATGGGAAGCCCTTAAGTATCTGGGAAGTCT
TGTGCAGTATTGGGGCCTGGAACTAAAAAGGAGTGCTATTAGTCTATTGGATACCCTAGCAATAGCAGTAGGTGAAG
GAACAGATAGGATTCTAGAATTTGTATTAGGAATTTGTAGAGCTATCCGCAACATACCTACAAGAATAAGACAGGGC
TTTGAAACAGCTTTGCTATAA
>703010505.W30.15
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGGTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATGCTACTGCCAGCAATAGCAGTATAATAGAGGGAATGAAAAATTGCTCTTTCAATATAACC
ACAGAATTAAGAGATAAGAGAGAGAAAAAGAATGCACTTTTTTATAAACTTGATATAGTACAACTAGATGGCAACTC
TAGTCAGTATAGATTAATAAATTGTAATACCTCAGTCATAACACAAGCCTGTCCAAAGGTCTCTTTTGACCCAATTC
CTATACATTATTGTGCTCCAGCTGGTTATGCGATTCTAAAGTGTAATAATAAGACATTCACTGGAACAGGACCGTGT
AATAATGTCAGCACAGTACAATGTACACATGGAATTAAGCCAGTGGTTCAACTCAACTATTGTTAAATGGTAGCCT
AGCAGAAGGAGAGATAATAATTAGATCTGAAAATATAACAAACAATGGCAAAACAATAATAGTACATCTCAATGAAT
CTGTAAAGATTGAGTGTACGAGACCCAATAATAAAACAAGAACAAGTATAAGAATAGGACCAGGACAAGCATTTTAT
GCAACAGGACAAGTAATAGGAGACATAAGAGAAGCACATTGTAACATTAGTGAAAGTAAATGGAATGAAACTTTACA
AAGGGTAAGTAAAAAATTAAAAGAATACTTCCCTCATCAGAATATAACATTTCAACCATCCTCAGGAGGGGACCTAG
AAATTACAACACATAGCTTTAATTGTGGAGGAGAATTTTTCTATTGCAATACATCAAGCCTGTTTAATAGGACATAT
ATGGCTAATAGTACAGATATGGCTAATAGTACAGAAACTAACAGTACACGAACCATCACAATCCGCTGCAGAATAAA
ACAAATTATAAACATGTGGCAGGAGGTGGGACGAGCAATGTATGCCCCTCCCATTGCAGGAAACATAACATGTATAT
CAAATATCACAGGACTACTATTGACAAGGGATGGAGGAAAAAACAATACGGATACGGAGACATTCAGACCTGGAGGA
GGAAATATGAAGGACAATTGGAGAAGTGAATTATATAAATATAAAGTGGTAGAAGTTAAGCCATTAGGAGTAGCACC
CACTAATGCAAGAAGGAGAGTGGTGGAGAGAGAAAAAAGAGCAGTGGGAATGGGAGCTGTGTTCCTTGGGTTCTTGG
GAGCGGCAGGAAGCACTATGGGCGCAGCATCAATAACGCTGACGGTACAGGCCAGACAATTATTGTCTGGTATAGTG
CAACAGCAAAGCAATTTGCTGAAGGCTATAGAGGCTCAACAGCATATGTTGAAACTCACGGTCTGGGGCATTAAACA
GCTCCAGGCAAGAGTCCTGGCCTTGGAAAGATACCTAAAGGATCAACAGCTCCTAGGGATGTGGGGCTGCTCTGGAA
AACTCATCTGCACCACTAATGTATATTGGAACTCTAGTTGGAGTAATAAAACTTATGGTGATATTTGGGATAACATG
ACCTGGATGCAGTGGGAGAGAGAAATTAGCAATTATACAGAAATAATATATGAATTGCTTGAAGAATCACAAAACCA
GCAGGAAAAGAATGAACAAGATTTACTAGCATTGGACAGATGGAACAGTCTGTGGAATTGGTTTAACATAACAAATT
GGCTGTGGTATATAAAAATATTCATAATGATAGTAGGAGGCTTGATAGGTTTAAGAATAATTTTTGCTGTGCTTTCT
TTAGTAAATAGAGTTAGGCAGGGATACTCACCTCTGTCGTTACAGACCCTTATCCCAAGCCCGAGGGGACCAGACAG
GCCCGGAGGAATCGAAGAAGAAGGTGGAGAGCAAGACAGAAACAGATCAACGCGATTAGTGAGCGGATTCTTAGCGC
TTGTCTGGGACGACCTGCGGAGCCTGTGCCTTTTCATCTACCACCGATTGAGAGACTTCATATTAATTGCAGCGAGA
GCGGGGGAACTTCTGGGACGCAGCAGTCTCAAGGGACTACGGAGAGGATGGGAAGCCCTTAAGTATCTGGGAAGTCT
TGTGCAGTATTGGGGCCTGGAACTAAAAAGGAGTGCTATTAGTCTATTGGATACCCTAGCAATAGCAGTAGGTGAAG
GAACAGATAGGATTCTAGAATTTGTATTAGGAATTTGTAGAGCTATCCGCAACATACCTACAAGAATAAGACAGGGC
TTTGAAACAGCTTTGCTATAA
>703010505.W30.30
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATGCTACTGCCAGCAATAGCAGTATAATAAAGGGAATGAAAAATTGCTCTTTCAATATAACC
ACAGAATTAAGAGATAAGAGAGAGAAAAAGAATGCACTTTTTTATAAACTTGATATAGTACAACTAGATGGCAACTC
TAGTCAGTATAGATTAATAAATTGTAATACCTCAGTCATAACACAAGCCTGTCCAAAGGTCTCTTTTGACCCAATTC
CTATACATTATTGTGCTCCAGCTGGTTATGCGATTCTAAAGTGTAACAATAAGACATTCACTGGAACAGGACCGTGT
AATAATGTCAGCACAGTACAATGTACACATGGAATTAAGCCAGTGGTTCAACTCAACTATTGTTAAATGGTAGCCT
AGCAGAAGGAGAGATAATAATTAGATCTGAAAATATAACAAACAATGGCAAAACAATAATAGTACATCTCAATGAAT
CTGTAAAGATTGAGTGTACGAGACCCAATAATAACACAAGAACAAGTATAAGAATAGGACCAGGACAAGCATTTTAT
GCAACAGGACAAGTAATAGGAGACATAAGAGAAGCACATTGTAACATTAGTGAAAGTAAATGGAATGAAACTTTACA
AAGGGTAAGTAAAAAATTAAAAGAATACTTCCCTCATAAGAATATAACATTTCAACCATCCTCAGGAGGGGACCTAG
AAATTACAACACATAGCTTTAATTGTGGAGGAGAATTTTTCTATTGCAATACATCAAGCCTGTTTAATAGGACATAT
ATGGCTAATAGTACAGATATGGCTAATAGTACAGAAACTAACAGTACACGAACCATCACAATCCGCTGCAGAATAAA
ACAAATTATAAACATGTGGCAGGAGGTGGGACGAGCAATGTATGCCCCTCCCATTGCAGGAAACATAACATGTATAT
```

FIG. 17B cont'd

CAAATATCACAGGACTACTATTGACAAGGGATGGAGGAAAAAACAATACGGATACGGAGACATTCAGACCTGGAGAA
GGAAATATGAAGGACAATTGAAGAAGTAAATTATATAAATATAAAGTGGTAGAAGTTAAGCCATTAGGAGTAGCACC
CACTAATGCAAGAAGGAGAGTGGTGAAGAGAGAAAAAAGAGCAGTGGGAATGGGAGCTGTGTTCCTGGGTTCTTGG
GAGCGGCAGGAAGCACTATGGGCGCAGCATCAATAACGCTGACGGTACAGGCCAGACAATTATTGTCTGGTATAGTG
CAACAGCAAAGCAATTTGCTGAAGGCTATAGAGGCTCAACAGCATATGTTGAAACTCACGGTCTGGGGCATTAAACA
GCTCCAGGCAAGAGTCCTGGCCTTGGAAAGATACCTAAAGGATCAACAGCTCCTAGGGATGTGGGGCTGCTCTGGAA
AACTCATCTGCACCACTAATGTATATTGGAACTCTAGTTGGAGTAATAAAACTTATGGTGATATTTGGGATAACATG
ACCTGGATGCAGTGGGAGAGAGAAATTAGCAATTATACAGAAATAATATATAAATTGCTTGAAGAATCACAAAACCA
GCAGGAAAAGAATGAACAAGATTTACTAGCATTGGACAGATGGAACAGTCTGTGGAATTGGTTTAACATAACAAATT
GGCTGTGGTATATAAAAATATTCATAATGATAGTAGGAGGCTTGATAGGTTTAAAAATAATTTTTGCTGTGCTTTCT
TTAGTAAATAGAGTTAGGCAGGGATACTCACCTCTGTCGTTGCAGACCCTTATCCCAAGCCCGAGGGGACCAGACAG
GCCCGGAGGAATCGAAGAAGAAGGTGGAGAGCAAGACAGAAACAGATCAACGCGATTAGTGAGCGGATTCTTAGCGC
TTGTCTGGGACGACCTGCGGAGCCTGTGCCTTTTCATCTACCACCGATTGAGAGACTTCATATTAATTGCAGCGAGA
GCGGGGGAACTTCTGGGACGCAGCAGTCTCAAGGGACTACGGAGAGGATGGGAAGCCCTTAAGTATCTGGGAAGTCT
TGTGCAGTATTGGGGCCTGGAACTAAAAAGGAGTGCTATTAGTCTATTGGATACCCTAGCAATAGCAGTAGGTGAAG
GAACAGATAGGATTCTAAAATTTGTATTAGGAATTTGTAGAGCTATCCGCAACATACCTACAAGAATAAGACAGGGC
TTTGAAACAGCTTTGCTATAA
>703010505.W30.33
ATGAGAGTGATGGGGATACAAAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTACCAGCAATAGCAGTACCAGCAATAGCAGTATAATAGAGGGAATGAAAAATTGCTCTTTCAATATAACC
ACAGAATTAAGAGATAAGAGAGAGAAAAAGAATGCACTTTTTTATAAACTTGATATAGTACAACTAGATGGCAACTC
TAGTCAGTATAGATTAATAAATTGTAATACCTCAGTCATAACACAAGCCTGTCCAAAGGTCTCTTTTTGACCCAATTC
CTATACATTATTGTGCTCCAGCTGGTTATGCGATTCTAAAGTGTAATAATAAGACATTCACTGGAACAGGACCGTGT
AATAATGTCAGCACAGTACAATGTACACATGGAATTAAGCCAGTGGTTCAACTCAACTATTGTTAAATGGTAGCCTA
GCAGAAGGAGAGATAATAATTAGATCTGAAAATATAACAAACAATGTCAAAACAATAATAGTACATCTCAATGAAT
CTGTAAAGATTGAGTGTACGAGACCCAGTAATAAAAACAAGAACAAGTATAAGAATAGGACCAGGACAAGCATTTTAT
GCAACAGGACAACTACTATTGACAAGGGATGGAGGAAACACGGGATACGGAGACATTCAGACCTGGAGGA
GGAAATATGAAGGACAATTGGAGAAGTGAATTATATAAATATAAAGTGGTAGAAGTTAAGCCATTAGGAGTAGCACC
CACTAATGCAAGAAGGAGAGTGGTGGAGAGAGAAAAAAGAGCAGTGGGAATGGGAGCTGTGTTCCTGGGTTCTTGG
GAGCGGCAGGAAGCACTATGGGCGCAGCATCAATAACGCTGACGGTACAGGCCAGACAATTATTGTCTGGTATAGTG
CAACAGCAAAGCAATTTGCTGAAGGCTATAGAGGCTCAACAGCATATGTTGAAACTCACGGTCTGGGGCATTAAACA
GCTCCAGGCAAGAGTCCTGGCCTTGGAAAGATACCTAAAGGATCAACAGCTCCTAGGGATGTGGGGCTGCTCTGGAA
AACTCATCTGCACCACTAATGTATATTGGAACTCTAGTTGGAGTAATAAAACTTATGGTGATATTTGGGATAACATG
ACCTGGATGCAGTGGGAGAGAGAAATTAGCAATTATACAGAAATAATATATAAATTGAATTGCTTGAAGAATCACAAAACCA
GCAGGAAAAGAATGAACAAGATTTACTAGCATTGGACAGATGGAACAGTCTGTGGAATTGGTTTAACATAACAAATT
GGCTGTGGTATATAAAAATATTCATAATGATAGTAGGAGGCTTGATAGGTTTAAGAATAATTTTTGCTGTGCTTTCT
TTAGTAAATAGAGTTAGGCAGGGATACTCACCTCTGTCGTTACAGACCCTTATCCCAAGCCCGAGGGGACCAGACAG
GCCCGGAGGAATCGAAGAAGAAGGTGGAGAGCAAGACAGAAACAGATCAACGCGATTAGTGAGCGGATTCTTAGCGC
TTGTCTGGGACGACCTGCGGAGCCTGTGCCTTTTCATCTACCACCGATTGAGAGACTTCATATTAATTGCAGCGAGA
GCGGGGGAACTTCTGGGACGCAGCAGTCTCAAGGGACTACGGAGAGGATGGGAAGCCCTTAAGTATCTGGGAAGTCT
TGTGCAGTATTGGGGCCTGGAACTAAAAAGGAGTGCTATTAGTCTATTGGATACCCTAGCAATAGCAGTAGGTGAAG
GAACAGATAGGATTCTAAAATTTGTATTAGGAATTTGTAGAGCTATCCGCAACATACCTACAAGAATAAGACAGGGC
TTTGAAACAGCTTTGCTATAA
>703010505.W30.26
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTAGCAATAGCAGTATAATAGAGGGAATGAAAAATTGCTCTTTCAATATAACCACAGAATTAAGAGATAAG
AGAGAGAAAAGAATGCACTTTTTTATAAACTTGATATAGTACAACTAGATGGCAACTCTAGTCAGTATAGATTAAT
AAATTGTAATACCTCAGTCATAACACAAGCCTGTCCAAAGGTCTCTTTTGACCCAATTCCTATACATTATTGTGCTC
CAGCTGGTTATGCGATTCTAAAGTGTAATAATAAGACATTCACTGGAACAGGACCGTGTAATAATGTCAGCACAGTA
CAATGTACACATGGAATTAAGCCAGTGGTTCAACTCAACTATTGTTAAATGGTAGCCTAGCAGAAGGAGAGATAAT
AATTAGATCTGAAAATATAACAAACAATGGCAAAACAATAATAGTACATCTCAATGAATCTGTAAAGATTGAGTGTA
CGAGACCCAATAATAACACAAGAACAAGTATAAGAATAGGACCAGGACAAGCATTTTATGCAACAGGACAAGTAATA
GGAGACATAAGAGAAGCATATTGTAACATTAGTGAAAGTAAATGGAATGAAACTTTACAAAGGGTAAGTAAAAAATT
AAAAGAATACTTCCCTCATAAGAATATAACATTTCAACCATCCTCAGGAGGGGACCTAGAAATTACAACACATAGCT
TTAATTGTGGAGGAGAATTTTTCTATTGCAATACATCAAGCCTGTTTAATAGGACATATATGGCTAATAGTACAGAT
ATGGCTAATAGTACAGATATGGCTAATAGTACAGAAACTAACAGTACACGAACCATCACAATCCGCTGCAGAATAAAACAAATTATAAACATGT
GCAGGAGGTGGGACGAGCAATGTATGCCCCTCCCATTGCAGGAAACATAACATGTATATCAAATATCACAGGACTAC

FIG. 17B cont'd

```
TATTGACAAGGGATGGAGGAAAAAACAATACGGATACGGAGACATTCAGACCTGGAGGAGGAAATATGAAGGACAAT
TGGAGAAGTGAATTATATAAATATAAAGTGGTAGAAGTTAAGCCATTAGGAGTAGCACCCACTAATGCAAGAAGGAG
AGTGGTGGAGAGAGAAAAAAGAGCAGTGGGAATGGGAGCTGTGTTCCTTGGGTTCTTGGGAGCGGCAGGAAGCACTA
TGGGCGCAGCATCAATAACGCTGACGGTACAGGCCAGACAATTATTGTCTGGTATAGTGCAACAGCAAAGCAATTTG
CTGAAGGCTATAGAGGCTCAACAGCATATGTTGAAACTCACGGTCTGGGGCATTAAACAGCTCCAGGCAAGAGTCCT
GGCCTTGGAAAGATACCTAAAGGATCAACAGCTCCTAGGGATGTGGGGCTGCTCTGGAAAACTCATCTGCACCACTA
ATGTATATTGGAACTCTAGTTGGAGTAATAAAACTTATGGTGATATTTGGGATAACATGACCTGGATGCAGTGGGAG
AGAGAAATTAGCAATTATACAGAAATAATATATGAATTGCTTGAAGAATCACAAAACCAGCAGGAAAAGAATGAACA
AGATTTACTAGCATTGGACAGATGGAACAGTCTGTGTGGAATTGGTTTAACATAACAAATTGGCTGTGGTATATAAAA
TATTCATAATGATAGTAGGAGGCTTGATAGGTTTAAGAATAATTTTTGCTGTGCTTTCTTTAGTAAATAGAGTTAGG
CAGGGATACTCACCTCTGTCGTTGCAGACCCTTATCCCAAGCCCGAGGGGACCAGACAGGCCCGGAGGAATCGAAGA
AGAAGGTGGAGAGCAAGACAGAAACAGATCAACGCGATTAGTGAGCGGATTCTTAGCGCTTGTCTGGGACGACCTGC
GGAGCCTGTGCCTTTTCATCTACCACCGATTGAGAGACTTCATATTAATTGCAGCGAGAGCGGGGGAACTTCTGGGA
CGCAGCAGTCTCAAGGGACTACGGAGAGGATGGGAAGCCCTTAAGTATCTGGGAAGTCTTGTGCAGTATTGGGGCCT
GGAACTAAAAAGGAGTGCTATTAGTCTATTGGATACCCTAGCAATAGCAATAGGTGAAGGAACAGATAGGATTCTAG
AATTTGTATTAGGAATTTGTAGAGCTATCCGCAACATACCTACAAGAATAAGACAGGGCTTTGAAACAGCTTTGCTA
TAA
>703010505.W30.10
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCAPATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTACCAGCAATAGCAGTATAATAGAGGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGACAAAACAATAATAGTACATCTCAATGAATCTGTAAAGATTGAGT
GTACGAGACCCAATAATAAACACAAGAACAAGTATAAGAATAGGACCAGGACAAGCATTTTATGCAACAGGACAAGTA
ATAGGAGACATAAGAGAAGCATATTGTAACATTAGTGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAATCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTACAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCGTTGCTATAA
>703010505.W30.28
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGATGACCCCACTCTGTGTCACTCTAAACTGTACCA
ATGCTACTGCCATCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAAACAATGACAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCACATTGTAACATTAGTGAAAGTAAATGGAATGAAACTTTACAAAGGGTAAGTAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCGCTGCAGAATAAAACAAATTATAAACAT
GTGGCAGGAGGTGGGACGAGCAATGTATGCCCCTCCCATTGCAGAAAACATAACATGTATATCAAATATCACAGGAC
TACTATTGACAAGGGATGGAGGAAAAAACAATACGGAGACATTCAGACCTGGAGGAGGAAATATGAAGGACAATTGG
```

FIG. 17B cont'd

```
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTAGAAAGATACCTAAAGGATCAACAGCTCCTAGGGATGTGGGGCTGCTCTGGAAAACTCATCTGCACCACTAATG
TATATTGGAACTCTAGTTGGAGTAATAAAAGTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W30.13
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGATGACCCCACTCTGTGTCACTCTAAACTGTACCA
ATGCTACTGCCATCAATAGCAGTATAATAGAGGGAATGAAAAATTGCTCTTTCAATATAACCACAGAATTAAGAGAT
AAGAGAGAGAAAAAGAATGCACTTTTTTATAAACTTGATATAGTACAACTAGATGGCAACTCTAGTCAGTATAGATT
AATAAATTGTAATACCTCAGTCATAACACAAGCCTGTCCAAAGGTCTCTTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATAACAATACACGACCCAATAACCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAAAAACAATACGGAGACATTCAGACCTGGAGGAGGAAATATGAAGGACAATTGG
AGAAGTGAATTATATAAATATAAAGTGGTAGAAGTTAAGCCATTAGGAATAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTAGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGTCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W30.19
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGAAACTGTACCAATGCTACTGCCAGCAATAGCAGTATAATAGAGGGAATGAAAAATTGCTCTTTC
AATATAACCACAGAATTAAGAGATAAGAGAGAGAAAAAGAATGCACTTTTTTATAAACTTGATATAGTACAACTAGA
TGGCAACTCTAGTCAGTATAGATTAATAAATTGTAATACCTCAGTCATAACACAAGCCTGTCCAAAGGTCTCTTTTG
ACCCAATTCCTATACATTATTGTGCTCCAGCTGGTTATGCGATTCTAAAGTGTAATAATAAGACATTCACTGGAACA
GGACCGTGTAATAATGTCAGCACAGTACAATGTACACATGGAATTAAGCCAGTGGTTTCAACTCAACTATTGTTAAA
TGGTAGCCTAGCAGAAGGAGAGATAATAATTAGATCTGAAAATATAACAAACAGTGGCAAAACAATAATAGTACATC
TCAATGAATCTGTAAAGATTGAGTGTACGAGACCCAATAATAAAACAAGAACAAGTATAAGAATAGGACCAGGACAA
GCATTTTATGCAACAGGACAAGTAATAGGAGACATAAGAGAAGCATATTGTAACATTAGTGAAAGTAAATGGAATGA
AACTTTACAAAGGGTAAGTAAAAAATTAAAAGAATACTTCCCTCATAAGAATATAACATTTCAACCATCATCAGGAG
GGGACCTAGAAATTACAACACATAGCTTTAATTGTGGAGGAGAATTTTTCTATTGCAATACATCAAGCCTGTTTAAT
AGGACATATATGGCTAATAGTACAGATATGGCTAATAGTACAGAAACTAACAGTACACGAATCATCACAATCCACTG
CAGAATAAAACAAATTATAAACATGTGGCAGGAGGTGGGACGAGCAATGTATGCCCCTCCCATTGCAGGAAACATAA
CATGTATATCAAGTATCACAGGACTACTATTGACAAGGGATGGAGGAGAAAACAATACGGAGACATTCAGACCTGGA
GGAGGAAATATGAAGGACAATTGGAGAAGTGAATTATATAAATATAAAGTGGTAGAAGTTAAGCCATTAGGAGTAGC
ACCCACTAATGCAAGAAGGAGAGTGGTGGAGAGAGAAAAAGAGCAGTGGGAATGGGAGCTGTGTTCCTTGGGTTCT
```

FIG. 17B cont'd

```
TGGGAGCGGCAGGAAGCACTATGGGCGCAGCATCAATAACGCTGACGGTACAGGCCAGACAATTATTGTCTGGTATA
GTGCAACAGCAAAGCAATTTGCTGAAGGCTATAGAGGCTCAACAGCATATGTTGAAACTCACGGTCTGGGGCATTAA
ACAGCTCCAGGCAAGAGTCCTGGCCTTGGAAAGATACCTAAAGGATCAACAGCTCCTAGGGATGTGGGGCTGCTCTG
GAAAACTCATCTGCCACCACTAATGTATATTGGAACTCTAGTTGGAGTAATAAAACTTATGGTGATATTTGGGATAAC
ATGACCTGGATGCAGTGGGAGAGAGAAATTAGCAATTATACAGAAATAATATATGAATTGCTTGAAGAATCACAAAA
CCAGCAGGAAAGAATGAACAAGATTTACTAGCATTGGACAGATGGAACAGTCTGTGGAATTGGTTTAACATAACAA
ATTGGCTGTGGTATATAAAAATATTCATAATGATAGTAGGAGGCTTGATAGGTTTAAGAATAATTTTTGCTGTGTTT
TCTTTAGTAAATAGAGTTAGGCAGGGATACTCACCTCTGTCGTTGCAGACCCTTATCCCAAGCCCGAGGGGACCAGA
CAGGCCCGGAGGAATCGAAGAAGAAGGTGGAGAGCAAGACAGAAACAGATCAACGCGATTAGTGAGCGGATTCTTAG
CGCTTGTCTGGGACGACCTGCGGAGCCTGTGCCTTTTCATCTACCACCGATTGAGAGACTTCATATTAATTGCAGCG
AGAGCGGGGGAACTTCTGGGACGCAGCAGTCTCAAGGGACTACGGAGAGGATGGGAAGCCCTTAAGTATCTGGGAAG
TCTTGTGCAGTATTGGGGCCTGGAACTAAAAAGGAGTGCTATTAGTCTATTGGATACCCTAGCAATAGCAGTAGGTG
AAGGAACAGATAGGATTCTAGAATTTGTATTAGGAATTTGTAGAGCTATCCGCAACATACCTACAAGAATAAGACAG
GGCTTTGAAACAGCTTTGCTATAA
>703010505.W30.32
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATAGCAGTATAAACTGTACCAATGCTACTGCCAATAGCAGTATAATAGAGGGAATGAAA
AATTGCTCTTTCAATATAACCACAGAATTAAGAGATAAGAGAGAGAAAAGAATGCACTTTTTTATAAACTTGATAT
AGTACAACTAGATGGCAACTCTAGTCAGTATAGATTAATAAATTGTAATACCTCAGTCATAACACAAGCCTGTCCAA
AGGTCTCTTTTGACCCAATTCCTATACATTATTGTGCTCCAGCTGGTTATGCGATTCTAAAGTGTAATAATAAGACA
TTCACTGGAACAGGACCGTGTAATAATGTCAGCACAGTACACATGGAATTAAGCCAGTGGTTTCAACTCA
ACTATTGTTAAATGGTAGCCTAGCAGAAGGAGAGATAATAATTAGATCTGAAAATATAACAAACAATGGCAAAACAA
TAATAGTACATCTCAATGAATCTGTAAAGATTGAGTGTACGAGACCCAATAATAAAACAAGAACAAGTATAAGAATA
GGACCAGGACAAGCATTTTATGCAACAGGACAAGTAATAGGAGACATAAGAGAAGCATATTGTAACATTAGTGAAAG
TAAATGGAATGAAACTTTACAAAGGGTAAGTAAAAAATTAAAAGAATACTTCCCTCATAAGAATATAACATTTCAAC
CATCCTGAGGGGGACCTAGAAATTACAACACATAGCTTTAATTGTGGAGGAGAATTTTTCTATTGCAATACATCA
AGCCTGTTTAATAGGACATATATGGCTAATAGTACAGATATGGCTAATAGTACAGAAACTAACAGTACACGAACCAT
CACAATCCGCTGCAGAATAAAACAAATTATAAACATGTGGCAGGAGGTGGGACGAGCAATGTATGCCCCTCCCATTG
CAGGAAACATAACATGTATATCAATATCACAGGACTACTATTGACAAGGGATGGAGGAAAAAACGATACGGAGACA
TTCAGACCTGGAGGAGGAAATATGAAGGACAATTGGAGAAGTGAATTATATAAATATAAAGTGGTAGAAGTTAAGCC
ATTAGGAGTAGCACCCACTAATGCAAGAAGGAGAGTGGTGGAGAGAGAAAAAAGAGCAGTGGGAATGGGAGCTGTGT
TCCTTGGGTTCTTGGGAGCGGCAGGAAGCACTATGGGCGCAGCATCAATAACGCTGACGGTACAGGCCAGACAATTA
TTGTCTGGTATAGTGCAACAGCAAAGCAATTTGCTGAAGGCTATAGAGGCTCAACAGCATATGTTGAAACTCACGGT
CTGGGGCATTAAACAGCTCCAGGCAAGAGTCCTGGCCTTGGAAAGATACCTAAAGGATCAACAGCTCCTAGGGATGT
GGGGCTGCTCTGGAAAACTCATCTGCACCACTAATGTATATTGGAACTCTAGTTGGAGTAATAAAACTTATGGTGAT
ATTTGGGATAACATGACCTGGATGCAGTGGGAGAGAGAAATTAGCAATTATACAGAAATAATATATGAATTGCTTGA
AGAATCACAAAACCAGCAGGAAAAGAATGAACAAGATTTACTAGCATTGGACAGATGGAACAGTCTGTGGAATTGGT
TTAACATAACAAATTGGCTGTGGTATATAAAAATATTCATAATGATAGTAGGAGGCTTGATAGGTTTAAGAATAATT
TTTGCTGTGCTTTCTTTAGTAAATAGAGTTAGGCAGGGATACTCACCTCTGTCGTTGCAGACCCTTATCCCAAGCCC
GAGGGGACCAGACAGGCCCGGAGGAATCGAAGAAGAAGGTGGAGAGAAAGACAGAAACAGATCAACGCGACTAGTGA
GCGGATTCTTAGCGCTTGTCTGGGACGACCTGCGGAGCCTGTGCCTTTTCATCTACCACCGATTGAGAGACTTCATA
TTAATTGCAGCGAGAGCGGGGGAACTTCTGGGACGCAGCAGTCTCAAGGGACTACGGAGAGGATGGGAAGCCCTTAA
GTATCTGGGAAGTCTTGTGCAGTATTGGGGCCTGGAACTAAAAAGGAGTGCTATTAGTCTATTGGATACCCTAGCAA
TAGCAGTAGGTGAAGGAACAGATAGGATTCTAGAATTTGTATTAGGAATTTGTAGAGCTATCCGCAACATACCTACA
AGAATAAGACAGGGCTTTGAAACAGCTTTGCTATAA
>703010505.W30.14
ATGAGAGTGATGGGGATACAGAGGAATTATCCACAATGGTGGATATGGAGCATGTTAGGCTTTTGGATGCTAATGAT
TTGTAAAGGGATGTGGGTCACAGTCTACTATGGGGTGGAAAGAAGCAAAAACTACTCTATTTTGTGCAT
CAGATGCTAAAGCATATGAGAAAGAAGTGCATAATGTTTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTGCCAGCAATATCAGTATAATAGAGGAAATGAAAAATTGCTCTTTCAATATAACCACAGAATTAAGAGAT
AAGAGAGAGAAAAGAATGCACTTTTTTATAAACTTGATATAGTACAACTAGATGGCAACTCTAGTCAGTATAGATT
AATAAATTGTAATACCTCAGTCATAACACAAGCCTGTCCTTTGACCCAATTCCTATACATTATTGTG
CTCCAGCTGGTTATGCGATTCTAAAGTGTAATAATAAGACATTCACTGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTGAAAATATAACAGACAATGTCAAAACAATAATAGTACATCTCAATGAATCTGTAAAGATTGAGT
GTACGAGACCCAATAATAAAACAAGAACAAGTATAAGAATAGGACCAGGACAAGCATTTTATGCAACAGGACAAGTA
ATAGGAGACATAAGAGAAGCATATTGTAACATTAGTGAATGAAACTTTACAAAGGGTAAGTAAAAAA
ATTAAAAGAATACTTCCCTCATAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGGACATATATGGCTAATAGTACA
GATATGGCTAATAGTACAGAAACTAACAGTACACGAACCATCACAATCCGCTGCAGAATAAAACAAATTATAAACAT
GTGGCAGGAGGTGGGACGAGCAATGTATGCCCCTCCCATTGCAGGAAACATAACATGTATATCAATATCACAGGAC
TACTATTGACAAGGGATGGAGGAAAAAACAATACGGATACGGAGACATTCAGACCTGGAGGAGGAAATATGAAGGAC
AATTGGAGAAGTGAATTATATAAATATAAAGTGGTAGAAGTTAAGCCATTAGGAGTAGCACCCACTAATGCAAGAAG
GAGAGTGGTGGAGAGAGAAAAAAGAGCAGTGGGAATGGGAGCTGTGTTCCTTGGGTTCTTGGGAGCGGCAGGAAGCA
```

FIG. 17B cont'd

```
CTATGGGCGCAGCATCAATAACGCTGACGGTACAGGCCAGACAATTATTGTCTGGTATAGTGCAACAGCAAAGAAAC
AGCTCCAGGCAAGAGTCCTGGCCTTGGAAAGATACCTAAAGGATCAACAGCTCCTAGGGATGTGGGGCTGCTCTGGA
AAACTCATCTGCACCACTAATGTATATTGGAACTCTAGTTGGAGTAATAAAACTTATGGTGATATTTGGGATAACAT
GACCTGGATGCAGTGGGAGAGAGAAATTAGCAATTATACAGAAATAATATATGAATTGCTTGAAGAATCACAAAACC
AGCAGGAAAAGAATGAACAAGATTTACTAGCATTGGACAGATGGAACAGTCTGTGGAATTGGTTTAACATAACAAAT
TGGCTGTGGTATATAAAAATATTCATAATGATAGTAGGAGGCTTGATAGGTTTAAGAATAATTTTTGCTGTGCTTTC
TTTAGTAAATAGAGTTAGGCAGGGATACTCACCTCTGTCGTTACAGACCCTTATCCCAAGCCCGAGGGGACCAGACA
GGCCCGGAGGAATCGAAGAAGAAGGTGGAGAGCAAGACAGAACAGATCAACGCGATTAGTGAGCGGATTCTTAGCG
CTTGTCTGGGACGACCTGCGGAGCCTGTGCCTTTTCATCTACCACCGATTGAGAGACTTCATATTAATTGCAGCGAG
AGCGGGGGAACTTCTGGGACGCAGCAGTCTCAAGGGACTACGGAGAGGATGGGAAGCCCTTAAGTATCTGGGAAGTC
TTGTGCAGTATTGGGGCCTGGAACTAAAAAGGAGTGCTATTAGTCTATTGGATACCCTAGCAATAGCAATAGGTGAA
GGAACAGATAGGATTCTAGAATTTGTATTAGGAATTTGTAGAGCTATCCGCAACATACCTACAAGAATAAGACAGGG
CTTTGAAACAGCTTTGCTATAA
>703010505.W53.19
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTTATGGGATCAAAGCCTCAAGCCATGTGTAAAGTTGACCCCACTCTGTGTCACTCTAAACTGTACCA
ATGCTACTAATGCTACTGCCAGCAATAGCAGTATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGATGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTGAAAATATAACACAATGGCAAAACAATAAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAGACATAAGAGAAGCACATTGTAACATTAGTGAAAGTAAATGGAATGAAACTTTACAAAGGGT
AAGTAAAAAATTAAAAGAATACTTCCCTCATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
AATAGTACAGAAACTAACAGTACACGAACCATCACACTCCACTGCAGAATAAAACAAATTATAAACATGTGGCAGGA
GGTGGGACGAGCAATGTATGCCCCTCCCATTGCAGGAAACATAACATGTATATCAAATATCACAGGACTACTATTGA
CAAGGGATGGAGGAAAAAACAATACGGAGACATTCGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGTTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCCGACAGGCCCGGAGGAATCGAAGAAGA
AGGTGGAGAGCAAGACAGAAACAGATCAACGCGATTAGTGCGGGATTCTTAGCGCTTGCCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGGTGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W53.27
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTAATGCTACTGCCAGCAATAGCAGTATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGATGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGATAATAATTAGATCTGAAAATATAACACAATGGCAAAACAATAAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAGACATAAGAGAAGCACATTGTAACATTAGTGAAAGTAAATGGAATGAAACTTTACAAAGGGT
AAGTAAAAAATTAAAAGAATACTTCCCTCATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
AATAGTACAGAAACTAACAGTACACGAACCATCACACTCCACTGCAGAATAAAACAAATTATAAACATGTGGCAGGA
GGTGGGACGAGCAATGTATGCCCCTCCCATTGCAGGAAACATAACATGTATATCAAATATCACAGGACTACTATTGA
CAAGGGATGGAGGAAAAAACAATACGGAGACATTCGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
```

FIG. 17B cont'd

```
CTTGGAAAGATACCTAAAGGATCAACAGCTCCTAGGGATGTGGGGTTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGCCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGATGGGAAGCCCTTAAGTGTCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W53.3
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTAATGCTACTGCCAGCAATAGCAGTATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGATGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTGAAAATATAACAGACAATGGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAGACATAAGAGAAGCACATTGTAACATTAGTGAAAGTAAATGGAATGAAACTTTACAAAGGGT
AAGTAAAAAATTAAAAGAATACTTCCCTCATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
AATAGTACAGAAACTAACAGTACACGAACCATCACACTCCACTGCAGAATAAAACAAATTATAAACATGTGGCAGGA
GGTGGGACGAGCAATGTATGCCCCTCCCATTGCAGGAAACATAACATGTATATCAAATATCACAGGACTACTATTGA
CAAGGGATGGAGGAAAAAACAATACGGAGACATTCGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGTTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGACAGAAACAGATCAACGCGATTAGTGAGCGGATTCTTAGCGCTTGCCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGGTGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGATTCTAGAAT
TTGTATTAGGAATTTGTAGAGCTATCCGCAACATACCTACAAGAATAAGACAGGGCTTTGAAACAGCTTTGCTATAA
>703010505.W53.17
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTACTAATGCTACTGCCAGCAATAGCAGTATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGATGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTGAAAATATAACAGACAATGGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAGACATAAGAGAAGCACATTGTAACATTAGTGAAAGTAAATGGAATGAAACTTTACAAAGGGT
AAGTAAAAAATTAAAAGAATACTTCCCTCATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
AATAGTACAGAAACTAACAGTACACGAACCATCACACTCCACTGCAGAATAAAACAAATTATAAACATGTGGCAGGA
GGTGGGACGAGCAATGTATGCCCCTCCCATTGCAGGAAACATAACATGTATATCAAATATCACAGGACTACTATTGA
CAAGGGATGGAGGAAAAAACAATACGGAGACATTCGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGT
GGTGGAGAGAGAAAAAGAGCAGTGGGAATGGGAGCTGTGTTCCTTGGGTTCTTGGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGTTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
```

FIG. 17B cont'd

```
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGGAGGAATCGAAGAAGA
AGGTGGAGAGCAAGCAGAAACAGATCAACGCGATTAGTGAGCGGATTCTTAGCGCTTGCCTGGGACGACCTGCGGA
GCCTGTGCCTTTTCATCTACCACCGATTGAGAGACTTCATATTAATTGCAGCGAGAGCGGGGGAACTTCTGGGACGC
AGCAGTCTCAAGGGACTACGGAGAGGGTGGGAAGCCCTTAAGTATCTGGGAAGTCTTGTGCAGTATTGGGGCCTGGA
ACTAAAAAGGAGTGCTATTAGTCTATTGGATACCCTAGCAATAGCAGTAGGTGAAGGAACAGATAGGGATTCTAGAAT
TTGTATTAGGAATTTGTAGAGCTATCCGCAACATACCTACAAGAATAAGACAGGGCTTTGAAACAGCTTTGCTATAA
>703010505.W53.30
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCGATGCATGAAGA
TGTAATTAGTTTATGGGATCAAAGCCTCAAGCCATGTGTAAAGTTGACCCCACTCTGTGTCACTCTAAACTGTACCG
ATGCTACTGCCAGCAATGCTACTGCCATCAATATCAGTATAATAGAGGAAATGAAAAATTGCTCTTTCAATATAACC
ACAGAATTAAGAGATAAGAGAGAGAAAAAGAATGCACTTTTTTATAAACTTGATATAGTACAACTAGATGGCAACTC
TAGTCAGTATAGATTAATAAATTGTAATACCTCAGTCATAACACAAGCCTGTCCAAAGGTCTCTTTTTGACCCAATTC
CTATACATTATTGTGCTCCAGCTGGTTATGCGATTCTAATAATAAGACATTCAATGGAACAGGACCGTGT
AATAATGTCAGCACAGTACAATGTACACATGGAATTAAGCCAGTGGTTTCAACTCAACTATTGTTAAATGGTAGCCT
AGCAGAAGGAGAGATAATAATTAGATCTGAAAATATAACAGACAATGGCAAAACAATAATAGTACATCTCAATGAAT
CTGTAAAGATTGAGTGTACGAGACCCAATAATAACACAAGAACAAGTATAAGAATAGGACCAGGACAAGCATTTTAT
GCAACAGGACAAGTAATAGGAGACATAAGAGAAGCACATTGTAACATTAGTGAAAGTAAATGGAATGAAACTTTACA
AAGGGTAAGTAAAAAATTAAAAGAATACTTCCCTCATAAGAATATAAACATTTCAACCATCCTCAGGAGGGGACCTAG
AAATTACAACACATAGCTTTAATTGTGGAGGAGAATTTTTCTATTGCAATACATCAAGCCTGTTTAATAGGACATAT
ATGGTTAATAGTACAGATATGGCTAATAGTACAGAAACTAACAGTACACGAACCATCACAATCCGCTGCAGAATAAA
ACAAATTATAAACATGTGGCAGGAGGTGGGACGAGCAATGTATGCCCCTCCCATTGCAGGAAACATAACATGTATAT
CAAATATCACAGGACTACTATTGACAAGGGATGGAGGAAATAACAATACGGAGACATTCGAGACATTCAGACCTGGA
GGAGGAAATATGAAGGACAATTGGAGAAGTGAATTATATAAATATAAAGTGGTAGAAGTTAAGCCATTAGGAGTAGC
ACCCACTAATGCAGAAGGAGAGTGGTGGAGAGAGAAAAAGAGCAGTGGGAATGGGAGCTGTGTTCCTTGGGTTCT
TGGGAGCGGCAGGAAGCACTATGGGCGCAGCATCAATAACGCTGACGGTACAGGCCAGACAATTATTGTCTGGTATA
GTGCAACAGCAAAGCAATTTGCTGAAGGCTATAGAGGCTCAACAGCATATGTTGAAACTCACGGTCTGGGGCATTAA
ACAGCTCCAGGCAAGAGTCCTGGCCTTGGAAAAGATACCCTAAAGGATCAACAGCTCCTAGGGATGTGGGGCTGCTCTG
GAAAACTCATCTGCACCACTAATGTATATTGGAACTCTAGTTGGAGTAATAAAACTTATGGTGATATTTGGGATAAC
ATGACCTGGATGCAGTGGGAGAGAGAAATTAGCAATTATACAGAGAATAATATATGAATTGCTTGAAGAATCACAAAA
CCAGCAGGAAAAGAATGAACAAGATTTACTAGCATTGGACAGATGGAACAGTCTGTGGAATTGGTTTAACATAACAA
ATTGGCTGTGGTATATAAAAATATTCATAATGATAGTAGGAGGCTTGATAGGTTTAAGAATAATTTTTGCTGTGCTT
TCTTTAGTAAATAGAGTTAGGCAGGGATACTCACCTCTGTCATTGCAGACCCTTATCCCAAGCCCGAGGGGACCAGA
CAGGCCCGGAGGAATCGAAGAAGAAGGTGGAGAGCAAGACAGAAACAGATCAACGCGATTAGTGAGCGGATTCTTAG
CGCTTGTCTGGGACGACCTGCGGAGCCTGTGCCTTTTCATCTACCACCGATTGAGAGACTTCATATTAATTGCAGCG
AGAGCGGGGGAACTTCTGGGACGCAGCAGTCTCAAGGGACTACGGAGAGGGATGGGAAGCCCTTAAGTATCTGGGAAG
TCTTGTGCAGTATTGGGGCCTGGAACTAAAAAGGAGTGCTATTAGTCTATTGGATACCCTAGCAATAGCAGTAGGTG
AAGGAACAGATAGGATTCTAGAATTTGTATTAGGAATTTGTAGAGCTATCCGCAACATACCTACAAGAATAAGACAG
GGCTTTGAAACAGCTTTGCTATAA
>703010505.W53.2
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTGTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTACTGCCAGCAATGCTACTGCCAGCAATGCTACTGCCAGCAATAGCAGTATAATAGAGGGAATGAAAAATTGC
TCTTTCAATATAACCACAGAATTAAGAGATAAGAGACAGAAAATGCACTTTTTATAAACTTGATATAGTACAACTAGATGGCAACTCTAGTCAGTATAGATTAATAAATTGTAATACCTCAGTCATAACACAAGCCTGTCCAAAGGTCTCTTTTTGACCCAATTCCTATACATATATGGCTAATAGTACAGATACTAACAGTACACGAATCATCACAATCCGCTGCAGAATAAACAAATTATAAACATGTGGCAGGAGGTGGGACGAGCAATGTATGCCCCTCCCATTGCAGGAAACATAACATGTATATCAAATATCACAGGACTACTATTGACAAGGGATGGAGGAAAAACAATACGGAGACATTCGAGACATTCAGACCTGGAGGAGGAGATATGAAGGACAATTGGAGAAGTGAATTATATAAATATAAAGTGGTAGAAGTTAAGCCATTAGGAGTAGCACCCACTAATGCAAGAAGGAGAGTGGTGGAGAGAGAAAAAAGAGCAGTGGGAATGGGAGCTGTGTTCCTTGGGTTCTTGGGAGCGGCAGGAAGCACTATGGGCGCAGCATCAATAACGCTGACGGTACAGGCCAGACAATTATTGTCTGGTATAGTGCAACAGCAAAGCAATTTGCTGAAGGCTATAGAGGCTCAACAGCATATGTTGAAACTCACGGTCTGGGGCATTAAACAGCTCCAGGCAAGAGTCCTGGCCTTGGAAAAGATACCCTAAAGGATCAACAGCTCCTAGGGATGTGGGGCTGCTCTGGAAAACTCATCTGCACCACTAATGTATATTGGAACTCTAGTTGGAGTAATAAAACTTATGGTGATATTTGGGATAACATGACCTGGATGCAGTGGGAGAGAGAAATTAGCAATTATACAGAGAATAATATATGAATTGCTTGAAGAATCACAAAACCAGCAGGAAAAGAATGAACAAGATTTACTAGCATTGGACAGATGGAACAGTCTGTGGAATTGGTTTAACATAACAAATTGGCTGTAGTATATAAAAATATTCATAATGATAGTAGGAGGCTTGATAGGTTTAAGAATAATTTTTGCTGTGTTTTCTTTAGTAAATAGAGTTAGGCAGGGATACTCACCTCTGTCATTGCAGACCCTTATCCCAAGCCCGAGGGGACCAGACAGGCCCGGAGGAATCGAAGAAGAAGGTGGAGAGCAAGACAGAAACAGATCAACGCGATTAGTGAGCGGATTCTTAGCGCTTGCCTGGGACGACCTGCGGAGCCTGTGCCTTTTCATCTACCACCGATTGAGAGACTTCATATTAATTGCAGCGAGAGCGGGGGAACTTCTGGGACGCAGCAGTCTCAAGGGACTACGGAGGGATGGGAAGCCCTTAAGTATCTGGGAAGTCTTGGGCAGTATTGGGGCCTGGAACTAAAAAGGAGTGCTATTAGTCTATTGGATACCCTAGCAATAGCA
```

FIG. 17B cont'd

```
GTAGGTGAAGGAACAGATAGGATTCTAGAATTTGTATTAGGAATTTGTAGAGCTATCCGCAACATACCTACAAGAAT
AAGACAGGGCTTTGAAACAGCTTTGCTATAA
>703010505.N53.10
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTACTGCCAGCAATGCTACTGCCAGCAATAGCAGTATAATAGAGGGAATGAAAAATTGC
TCTTTCAATATAACCACAGAATTAAGAGATAAGAGAGAGAAAAAGAATGCACTTTTTTATAAACTTGATATAGTACA
ACTAGATGGCAACTCTAGTCAGTATAGATTAATAAATTGTAATACCTCAGTCATAACACAAGCCTGTCCAAAGGTCT
CTTTTGACCCAATTCCTATACATTATTGTGCTCCAGCTGGTTATGCGATTCTAAAGTGTAATAATAAGACATTCAAT
GGAACAGGACCGTGTAATAATGTCAGCACAGTACAATGTACACATGGAATTAAGCCAGTGGTTTCAACTCAACTATT
GTTAAATGGTAGCCTAGCAGAAGGAGAGATAATAATTAGATCTGAAAATATAACAGACAATGGCAAACAATAATAG
TACATCTCAATGAATCTGTAAAGATTGAGTGTACGAGACCCAGTAATAACACAAGAACAAGTATAAGAATAGGACCA
GGACAAGCATTTTATGCAACAGGACAAGTAATAGGAGACATAAGAGAAGCACATTGTAACATTAGTGAAAGTAAATG
GAATGAAACTTTACAAAGGGTAAGTAAAAAATTAAAAGAATACTTCCCTCATAAGAATATAACATTTCAACCATCCT
CAGGAGGGGACCTAGAAATTACAACACATAGTTTTAATTGTGGAGGAGAATTTTTCTATTGCAATACATCAAGCCTG
TTTAATAGGACATATATGGCTAATAGTACAGAAACTAACAGTACACGAATCATCACAATCCGCTGCAGAATAAAACA
AATTATAAACATGTGGCAGGAGGTGGGACGAGCAATGTATGCCCCTCCCATTGCAGGAAACATAACATGTATATCAA
ATATCACAGGACTACTATTGACAAGGGATGGAGGAAAAAACAATACGGAGACATTCGAGACATTCAGACCTGGAGGA
GGAAATATGAAGGACAATTGGAGAAGTGAATTATATAAATATAAAGTAGTAGAAGTTAAGCCATTAGGAGTAGCACC
CACTAATGCAAGAAGGAGAGTGGTGGAGAGAGAAAAAGAGCAGTGGGAATGGGAGCTGTGTTCCTTGGGTTCTTGG
GAGCGGCAGGAAGCACTATGGGCGCAGCATCAATAACGCTGACGGTACAGGCCAGACAATTATTGTCTGGTATAGTG
CAACAGCAAAGCAATTTGCTGAAGGCTATAGAGGCTCAACAGCATATGTTGAAACTCACGGTCTGGGGCATTAAACA
GCTCCAGGCAAGAGTCCTGGCCTTGGAAAGATACCTAAAGGATCAACAGCTCCTAGGGATGTGGGGCTGCTCTGGAA
AACTCATCTGCACCACTAATGTATATTGGAACTCTAGTTGGAGTAATAAAACTTATGGTGATATTTGGGATAACATG
ACCTGGATGCAGTGGGAGAGAGAAATTAGCAATTATACAGAAACAATATATGAATTGCTTGAAGAATCACAAAACCA
GCAGGAAAAGAATGAACAAGATTTACTAGCATTGGACAGATGGAACAGTCTGTGGAATTGGTTTAACATAACAAATT
GGCTGTGGTATATAAAAATATTCATAATGATAGTAGGAGGCTTGATAGGTTTAAGAATAATTTTTGCTGTGCTTTCT
TTAGTAAATAGAGTTAGGCAGGGATACTCACCTCTGTCGTTGCAGACCCTTATCCCAAGCCCGAGGGGACCAGACAG
GCCCGGAGGAATCGAAGAAGAAGGTGGAGAGCAAGACAGAAACAGATCAACGGCGATTAGTGAGCGGATTCTTAGCGC
TTGCCTGGGACGACCTGCGGAGCCTGTGCCTTTTCATCTACCACCGATTGAGAGACTTCATATTAATTGCAGCGAGA
GCGGGGGAACTTCTGGGACGCAGCAGTCTCAAGGGACTACGGAGAGGATGGGAAGCCCTTAAGTATCTGGGAAGTCT
TGTGCAGTATTGGGGCCTGGAACTAAAAAGGAGTGCTATTAGTCTATTGGATACCCTAGCAATAGCAGTAGGTGAAG
GAACAGATAGGATTCTAGAATTTGTATTAGGAATTTGTAGAGCTATCCGCAACATACCTACAAGAATAAGACAGGGC
TTTGAAACAGCTTTGCTATAA
>703010505.N53.29
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTACTGCCAGCAATGCTACTGCCATCAATAGCAGTATAATAGAGGGAATGAAAAATTGCTCTTTCAATATAACC
ACAGAATTAAGAGATAAGAGAGAGAAAAAGAATGCACTTTTTTATAAACTTGATATAGTACAACTAGATGGCAACTC
TAGTCAGTATAGATTAATAAATTGTAATACCTCAGTCATAACACAAGCCTGTCCAAAGGTCTCTTTTGACCCAATTC
CTATACATTATTGTGCTCCAGCTGGTTATGCGATTCTAAAGTGTAATAATAAGACATTCAATGGAACAGGACCGTGT
AATAATGTCAGCACAGTACAATGTACACATGGAATTAAGCCAGTGGTTTCAACTCAACTATTGTTAAATGGTAGCCT
AGCAGAAGGAGAGATAATAATTAGATCTGAAAATATAACAAACAATGCCAAAACAATAATAGTACATCTCAATGAAT
CTGTAAAGATTGAGTGTACGAGACCCAGTAATAACACAAGAACAAGTATAAGAATAGGACCAGGACAAGCATTTTAT
GCAACAGGACAAGTAATAGGAGACATAAGAGAAGCACATTGTAACATTAGTGAAAGTAAATGGAATGAAACTTTACA
AAGGGTAAGTAAAAAATTAAAAGAATACTTCCCTCATAAGAATATAACATTTCAACCATCCTCAGGAGGGGACCTAG
AAATTACAACACATAGCTTTAATTGTGGAGGAGAATTTTTCTATTGCAATACATCAAGCCTGTTTAATAGGACATAT
ATGGCTAATAGTACAGAAACTAACAGTACACGAATCATCACAATCCGCTGCAGAATAAAACAATTATAAACATGTG
GCAGGAGGTGGGACGAGCAATGTATGCCCCTCCCATTGCAGGAAACATAACATGTATATCAAATATCACAGGACTAC
TATTGACAAGGGATGGAGGAAAAAACAATACGGAGACATTCGAGACATTCAGACCTGAAGGAGGAAATATGAAGGAC
AATTGGAGAAGTGAATTATATAAATATAAAGTGGTAGAAGTTAAGCCATTAGGAGTAGCACCCACTAATGCAAGAAG
GAGAGTGGTGGAGAGAGAAAAAGAGCAGTGGGAATGGGAGCTGTGTTCCTTGGGTTCTTGGGAGCGGCAGGAAGCA
CTATGGGCGCAGCATCAATAACGCTGACGGTACAGGCCAGACAATTATTGTCTGGTATAGTGCAACAGCAAAGCAAT
TTGCTGAAGGCTATAGAGGCTCAACAGCATATGTTGAAACTCACGGTCTGGGGCATTAAACAGCTCCAGGCAAGAGT
CCTGGCCTTGGAAAGATACCTAAAGGATCAACAGCTCCTAGGGATGTGGGGCTGCTCTGGAAAACTCATCTGCACCA
CTAATGTATATTGGAACTCTAGTTGGAGTAATAAAACTTATGGTGATATTTGGGATAACATGACCTGGATGCAGTGG
GAGAGAGAAATTAGCAATTATACAGAAATAATATATGAATTGCTTGAAGAATCACAAAACCAGCAGGAAAAGAATGA
ACAAGATTTACTAGCATTGGACAGATGGAACAGTCTGTGGAATTGGTTTAACATAACAAATTGGCTGTGGTATATAA
AAATATTCATAATGATAGTAGGAGGCTTGATAGGTTTAAGAATAATTTTTGCTGTGCTTTCTTTAGTAAATAGAGTT
AGGCAGGGATACTCACCTCTGTCATTGCAGACCCTTATCCCAAGCCCGAGGGGACCAGACAGGCCCGGAGGAATCGA
AGAAGAAGGTGGAGAGCAAGACAGAAACAGATCAACGCGATTAGTGAGCGGATTCTTAGCGCTTGCCTGGGACGACC
TGCGGAGCCTGTGCCTTTTCATCTACCACCGATTGAGAGACTTCATATTAATTGCAGCGAGAGCGGGGGAACTTCTG
GGACGCAGCAGTCTCAAGGGACTACGGAGAGGATGGGAAGCCCTTAAGTATCTGGGAAGTCTTGTGCAGTATTGGGG
CCTGGAACTAAAAAGAAGTGCTATTAGTCTATTGGATACCCTAGCAATAGCAGTAGGTGAAGGAACAGATAGGATTC
```

FIG. 17B cont'd

TAGAATTTGTATTAGGAATTTGTAGAGCTATCCGCAACATACCTACAAGAATAAGACAGGGCTTTGAAACAGCTTTG
CTATAA
>703010505.W53.14
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
CTGCCAATGCTACTGCCAGCAATAGCAGTATAATAGAGGGAATGAAAAATTGCTCTTTCAATATAACCACAGAATTA
AGAGATAAGAGAGAGAGAAAAAGAATGCACTTTTTTTATAAACTTGATATAGTACAACTAGATGGCAACTCTAGTCAGTA
TAGATTAATAAATTGTAATACCTCAGTCATAACACAAGCCTGTCCAAAGGTCTCTTTTGACCCAATTCCTATACATT
ATTGTGCTCCAGCTGGTTATGCGATTCTAAAGTGTAATAATAAGACATTCAATGGAACAGGACCGTGTAATAATGTC
AGCACAGTACAATGTACACATGGAATTAAGCCAGTGGTTTCAACTCAACTATTGTTAAATGGTAGCCTAGCAGAAGG
AGAGATAATAATTAGATCTGAAAATATAACAGACAATGGCAAAACAATAATAGTACATCTCAATGAATCTGTAAAGA
TTGAGTGTACGAGACCCAGTAATAACACAAGAACAAGTATAAGAATAGGACCAGGACAAGCATTTTATGCAACAGGA
CAAGTATAGGAGACATAGAGAAGCACATTGTAACATTAGTGAAAGTAAATGGAATGAAACTTTACAAAGGGTAAG
TAAAAAATTAAAAGAATACTTCCCTCATAAGAATATAACATTTCAACCATCCTCAGGAGGGGACCTAGAAATTACAA
CACATAGCTTTAATTGTGGAGGAGAATTTTTCTATTGCAATACATCAAGCCTGTTTAATAGGACATATATGGCTACT
AGTACAGATATGGCTAATAGTACAGAAACTAACAGTACACGAATCATCACAATCCGCTGCAGAATAAAACAAATTAT
AAACATGTGGCAGGAGGTGGGACGAGCAATGTATGCCCCTCCCATTGCAGGAAACATAACATGTATATCAAATATCA
CAGGACTACTATTGACAAGGGATGGAGGAAAAAACAATACGGAGACATTCGAGACATTCAGACCTGGAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGTTGGAGTAATAAAACTTATGGTGATATTTGGGATAACATGACCTGG
ATGCAGTGGGAGAGAGAGAAATTAGCAATTATACAGAAACTAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGTGAGAGCGGGG
GAACTTCTGGGACGCAGCAGTCTCAAGGGACTACGGAGAGGATGGGAAGCCCTTAAGTATCTGGGAAGTCTTGTGCA
GTATTGGGGCCTGGAACTAAAAAGGAGTGCTATTAGCTCTATTGGATACCCTAGCAATAGCAGTAGGTGAAGGAACAG
ATAGGATTCTAGAATTTGTATTAGGAATTTGTAGAGCTATCCGCAACATACCTACAAGAATAAGACAGGGCTTTGAA
ACAGCTTTGCTATAA
>703010505.W53.6
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTTTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTAACCCCACTCTGTGTCACTCTAAACTGTACCA
ATGCTACTAATGCTACTGCCAGCAATAGCAGTATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGATGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACCGTGTAATAAT
GTCAGCACAGTACAATGTACTCATGGAATTAAGCCAGTGGTTTCAACTCAACTATTGTTAAATGGTAGCCTAGCAGA
AGGAGAGATAATAATTAGATCTGAAAATATAACAGACAATGGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAGACATAAGAGAAGCACATTGTAACATTAGTGAAAGTAAATGGAATGAAACTTTACAAAGGGT
AAGTAAAAAATTAAAAGAATACTTCCCTCATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
AATAGTACAGAAACTAACAGTACACGAACCATCACAATCCGCTGCAGAATAAAACAAATTATAAACATGTGGCAGGA
GGTGGGACGAGCAATGTATGCCCCTCCCATTGCAGGAAACATAACATGTATATCAAATATCACAGGACTACTATTGA
CAAGGGATGGAGGAGAAAACAATACGGAGACATTCGAGACATTCAGACCTGGAGGAGGAAATATGAAGGACAATTGG
AGAAGTGAATTATATAAATATAAAGTGGTAGAAGTTAAGCCATTAGGAGTAGCACCCACTAATGCAAGAAGGAGAGC
GGTGGAGAGAGAAAAAAGAGCAGTGGGAATGGGAGCTGTGTTCCTTGGGTTCTTAGGAGCGGCAGGAAGCACTATGG
GCGCAGCATCAATAACGCTGACGGTACAGGCCAGACAATTATTGTCTGGTATAGTGCAACAGCAAAGCAATTTGCTG
AAGGCTATAGAGGCTCAACAGCATATGTTGAAACTCACGGTCTGGGGCATTAAACAGCTCCAGGCAAGAGTCCTGGC
CTTGGAAAGATACCTAAAGGATCAACAGCTCCTAGGGATGTGGGGCTGCTCTGGAAAACTCATCTGCACCACTAATG
TATATTGGAACTCTAGTTGGAGTAATAAAACTTATGGTGATATTTGGGATAACATGACCTGGATGCAGTGGGAGAGA
GAAATTAGCAATTATACAGAAATAATATATGAATTGCTTGAAGAATCACAAAACCAGCAGGAAAAGAATGAACAAGA
TTTACTAGCATTGGACAGATGGAACAGTCTGTGGAATTGGTTTAACATAACAAATTGGCTGTGGTATATAAAAATAT
TCATAATGATAGTAGGAGGCTTGATAGGTTTAAGAATAATTTTTGCTGTGCTTTCTTTAGTAAATAGAGTTAGGCAG
GGATACTCACCTCTGTCGTTGCAGACCCTTATCCCAAGCCCGAGGGGACCAGACAGGCCCGAGGAATCGAAGAAGA
AGGTGGAGAGCAAGACAGAAACAGATCAACGCGATTAGTGAGCGGATTCTTAGCGCTTGCCTGGGACGACCTGCGGA
GCCTGTGCCTTTTCATCTACCACCGATTGAGAGACTTCATATTAATTGCAGCGAGAGCGGGGAACTTCTGGACGC
AGCAGTCTCAAGGGACTACGGAGAGGATGGGAAGCCCTTAAGTATCTGGGAAGTCTTGTGCAGTATTGGGGCCTGGA

FIG. 17B cont'd

ACTAAAAAGGAGTGCTATTAGTCTATTGGATACCCTAGCAATAGCAGTAGGTGAAGGAACAGATAGGATTCTAAAAT
TTGTATTAGGAATTTGTAGAGCTATCCGCAACATACCTACAAGAATAAGACAGGGCTTTGAAACAGCTTTGCTATAA
>703010505.W53.25
ATGAGAGTGATGGGGATACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGGAAAATGACATGGTAGATCAGATGCATGAAGA
TGTAATTAGTTTATGGGATCAAAGCCTCAAGCCATGTGTAAAGTTGACCCCACTCTGTGTCACTCTAAACTGTACCG
ATGCTACTGCCAGCAATGCTACTGCCAGCAATGCTACTGCCAGCAATAGCAGTATAATAGAGGGAATGAAAAATTGC
TCTTTCAATATAACCACAGAATTAAGAGATAAGAGAGAGAAAAAGAATGCACTTTTTTTATAAACTTGATATAGTACA
ACTAGATGGCAACTCTAGTCAGTATAGATTAATAAATTGTAATACCTCAGTCATAACACAAGCCTGTCCAAAGGTCT
CTTTTGACCCAATTCCTATACATTATTGTGCTCCAGCTGGTTATGCGATTCTAAAGTGTAATAACAAGACATTCAAT
GGAACAGGACCGTGTAATAATGTCAGCACAGTACAATGTACACATGAATTAAGCCAGTGGTTTCAACTCAACTATT
GTTAAATGGTAGCCTAGCAGAAGGAGAGATAATAATTAGATCTGAAAATATAACAGACAATGGCAAAACAATAATAG
TACATCTCAATGAATCTGTAAAGATTGAGTGTACGAGACCCAGTAATAACACAAGAACAAGTATAAGAATAGGACCA
GGACAAGCATTTTATGCAACAGGACAAGTAATAGGAGACATAAGAGAAGCACATTGTAACATTAGTGAAAATAAATG
GAATGAAACTTTACAAAGGGTAAGTAAAAAATTAAAAGAATACTTCCCTCATAAGAATATAACATTTCAACCATCCT
CAGGAGGGGACCTAGAAATTACAACACATAGCTTTAATTGTGGAGGAGAATTTTTCTATTGCAATACATCAAGCCTG
TTTAATAGGACATATATGGCTAATAGTACAGATATGGCTAATAGTACAGAAACTAACAGTACACGAACCATCACAAT
CCGCTGCAGAATAAAACAAATTATAAACATGTGGCAGGAGGTGGGACGAGCAATGTATGCCCCTCCCATTGCAGGAA
ACATAACATGTATATCAAATATCACAGGACTACTATTGACAAGGGATGGAGGAAAAACAATACGGAGACATTCGAG
ACATTCAGACCTGGAGGAGGAAATATGAAGCAATTGGGAGAAGTGAATTATATAAATATAAAGTGGTAGAAGTTAA
GCCATTAGGAGTAGCACCCACTAATGCAAGAAGGAGAGTGGTGGAGAGAGAAAAAAGAGCAGTGGGAATGGGAGCTG
TGTTCCTTGGGTTCTTGGGAGCGGCAGGAAGCACTATGGGCGCAGCATCAATAACGCTGACGGTACAGGCCAGACAA
TTATTGTCTGGTATAGTGCAACAGCAAAGCAATTTGCTGAAGGCTATAGAGGCTCAACAGCATATGTTGAAACTCAC
GGTCTGGGGCATTAAACAGCTCCAGGCAAGAGTCCTGGCCTTGGAAAGATACCTAAAGGATCAACAGCTCCTAGGGA
TGTGGGGCTGCTCTGGAAAACTCATCTGCACCACTAATGTATATTGGAACTCTAGTTGGAGTAATAAAACTTATGGT
GATATTTGGGATAACATGACCTGGATGCAGTGGGAGAGAGAAATTAGCAATTATACAGAAATAATATATGAATTGCT
TGAAGAATCACAAAACCAGCAGGAAAAGAATGAACAAGATTTACTAGCATTGGACAGATGGAACAGTCTGTGGAATT
GGTTTAACATAACAAATTGGCTGTGGTATATAAAAATATTCATAATGATAGTAGGAGGCTTGATAGGTTTAAGAATA
ATTTTTGCTGTGCTCTCTTTAGTAAATAGAGTTAGGCAGGGATACTCACCTCTGTCATTGCAGACCCTTATCCCAAG
CCCGACGGACCCAGACAGGCCCGGACGGAATCGAAGAAGAAGGTGGAGACAAGACAGACAGAAGAGATCAACGCGATTAG
TGAGCGGATTCTTAGCGCTTGTCTGGGACGACCTGCGGAGCCTGTGCCTTTCATCTACCACCGATTGAGAGACTTC
ATATTAATTGCAGCGAGAGCGGGGGAACTTCTGGGACGCAGCAGTCTCAAGGGACTACGGAGAGGATGGGAAGCCCT
TAAGTATCTGGGAAGTCTTGTGCAGTATTGGGGCCTGGAACTAAAAGGGAGTGCTATTAGTCTATTGGATACCCTAG
CAATAGCAGTAGGTGAAGGAACAGATAGGATTCTAGAATTTGCATTAGGAATTTGTAGAGCTATCCGCAACATACCT
ACAAGAATAAGACAGGGCTTTGAAACAGCTTTGCTATAA
>703010505.W53.19
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGGAAAATGACATGGTAGATCAGATGCATGAAGA
TGTAATTAGTTTATGGGATCAAAGCCTCAAGCCATGTGTAAAGTTGACCCCACTCTGTGTCACTCTAAACTGTACCG
ATGCTACTGCCAGCAATGCTACTGCCAGCAATGCTACTGCCAGCAATAGCAGTATAATAGAGGGAATGAAAAATTGC
TCTTTCAATATAACCACAGAATTAAGAGATAAGAGAGAGAAAAAGAATGCACTTTTTTATAAACTTGATATAGTACA
ACTAGATGGCAACTCTAGTCAGTATAGATTAATAAATTGTAATACCTCAGCCATAACACAAGCCTGTCCAAAGGTCT
CTTTTGACCCAATTCCTATACATTATTGTGCTCCAGCTGGTTATGCGATTCTAAAGTGTAATAATAAGACATTCAAT
GGAACAGGACCGTGTAATAATGTCAGCACAGTACAATGTACACATGAATTAAGCCAGTGGTTTCAACTCAACTATT
GTTAAATGGTAGCCTAGCAGAAGGAGAGATAATAATTAGATCTGAAAATATAACAGACAATGGCAAAACAATAATAG
TACATCTCAATGAATCTGTAAAGATTGAGTGTACGAGACCCAGTAATAACACAAGAACAAGTATAAGAATAGGACCA
GGACAAGCATTTTATGCAACAGGACAAGTAATAGGAGACATAAGAGAAGCACATTGTAACATTAGTGAAAGTAAATG
GAATGAAACTTTACAAAGGGTAAGTAAAAAATTAAAAGAATACTTCCCTCATAAGAATATAACATTTCAACCATCCT
CAGGAGGGGACCTAGAAATTACAACACATAGCTTTAATTGTGGAGGAGAATTTTTCTATTGCAATACATCAAGCCTG
TTTAATAGGACATATATGGCTAATAGTACAGACCAATCATCACAATCCACTGCAGAATAAAACA
AATTATAAACATGTGGCAGGAGGTGGGACGAGCAATGTATGCCCCTCCCATTGCAGGAAACATAACATGTATATCAA
ATATCACAGGACTACTATTGACAAGGGATGGAGGAAATAACAATACGGAGACATTCAGACCTGGAGGAGGAAATATG
AAGGACAATTGGAGAAGTGAATTATATAAATATAAAGTGGTAGAAGTTAAGCCATTAGGAGTAGCACCCACTAATGC
AAGAAGGAGAGTGGTGGAGAGAGAAAAAAGAGCAGTGGGAATGGGAGCTGTGTTCCTTGGGTTCTTGGGAGCGGCAG
GAAGCACTATGGGCGCAGCATCAATAACGCTGACGGTACAGGCCAGACAATTATTGTCTGGTATAGTGCAACAGCAA
AGCAATTTGCTGAAGGCTATAGAGGCTCAACAGCATATGTTGAAACTCACGGTCTGGGGCATTAAACAGCTCCAGGC
AAGAGTCCTGGCCTTGGAAAGATACCTAAAGGATCAACAGCTCCTAGGGATGTGGGGCTGCTCTGGAAAACTCATCT
GCACCACTAATGTATATTGGAACTCTAGTTGGAGTAATAAAACTTATGGTGATATTTGGGATAACATGACCTGGATG
CAGTGGGAGAGAGAAATTAGCAATTATACAGAAATAATATATGAATTGCTTGAAGAATCACAAAACCAGCAGGAAAA
GAATGAACAAGATTTACTAGCATTGGACAGATGGAACAGTCTGTGGAATTGGTTTAACATAACAAACTGGCTGTGGT
ATATAAAATATTCATAATGATAGTAGGAGGCTTGATAGGTTTAAGAATAATTTTTGCTGTGCTCTCTTTAGTAAAT
AGAGTTAGGCAGGGATACTCACCTCTGTCTTTGCAGACCCTTATCCCAAGCCCGAGGGGACCGACAGGCCCGGAGG
AATCGAAGAAGAAGGTGGAGAGCAAGACAGAAACAGATCAACGCGATTAGTGAGCGGATTCTTAGCGCTTGCCTGGG
ACGACCTGCGGAGCCTGTGCCTTTTCATCTACCACCGATTGAGAGACTTCATATTAATTGCAGCGAGAGCGGGGGAA
CTTCTGGGACGCAGCAGTCTCAAGGGACTACGGAGAGGGTGGGAAGCCCTTAAGTATCTGGGAAGTCTTGTGCAGTA
TTGGGGCCTGGAACTAAAAGGGAGTGCTATTAGTCTATTGGATACCCTAGCAATAGCAGTAGGTGAAGGAACAGATA

FIG. 17B cont'd

```
GGATTCTAGAATTTGTATTAGGAATTTGTAGAGCTATCCGCAACATACCTACAAGAATAAGACAGGGCTTTGAAACA
GCTTTGCTATAA
>793010505.N53.22
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTAATGCTACTGCCAGCAATAGCAGTATAATAGAGGGAATGAATAGCAGTATAATAGAGGGAATGAAAAATTGC
TCTTTCAATATAACCACAGAATTAAGAGATAAGAGAGAGAAAAAGAATGCACTTTTTTATAAACTTGATATAGTACA
ACTAGATGGCAACTCTAGTCAGTATAGATTAATAAATTGTAATACCTCAGTCATAACACAAGCCTGTCCAAAGGTCT
CTTTTGACCCAATTCCTATACATTATTGTGCTCCAGCTGGTTATGCGATTCTAAAGTGTAATAATAAGACATTCAAT
GGAACAGGACCGTGTAATAATGTCAGCACAGTACAATGTACACATGGAATTAAGCCAGTGGTTTCAACTCAACTATT
GTTAAATGGTAGCCTAGCAGAAGGAGAGATAATAATTAGATCTGAAAACATAACAGACAATGGCAAAACAATAATAG
TACATCTCAATGAATCTGTAAAGATTGAGTGTACGAGACCCAGTAATAACACAAGAACAAGTATAAGAATAGGACCA
GGACAAGCATTTTATGCAACAGGACAAGTAATAGGAGACATAAGAGAAGCACATTGTAACATTAGTGAAAGTAAATG
GAATGAAACTTTACAAAGGGTAAGTGAAAAATTAAAAGAATACTTCCCTCATAAGAATATAACATTTCAACCATCCT
CAGGAGGGGACCTAGAAATTACAACACATAGCTTTTAATTGTGGAGGAGAATTTTTCTATTGCAATACATCAAGCCTG
TTTAATAGGACATATATGGCTACTAGTACAGATATGGCTAATAGTACAGAAACTAACAGTACACGAATCATCACAAT
CCGCTGCAGAATAAAACAAATTATAAACATGTGGCAGGAGGTGGGACGAGCAATGTATGCCCCTCCCATTGCAGGAA
ACATAACATGTATATCAAATATCACAGGACTACTATTGACAAGGGATGGAGGAAAAAACAATACGGAGACAPTCGAG
ACATTCAGACCTGGAGGAGGAAATATGAAGGACAATTGGAGAAGTGAATTATATAAATATAAAGTGGTAGAAGTTAA
GCCATTAGGAGTAGCACCCACTAATGCAAGAAGGAGAGTGGTGGAGAGAGAAAAAGAGCAGTGGGAATGGGAGCTG
TGTTCCTTGGGTTCTTGGGAGCGGCAGGAAGCACTATGGGCGCAGCATCAATAACGCTGACGGTACAGGCCAGACAA
TTATTGTCTGGTATAGTGCAACAGCAAAGCAATTTGCTGAAGGCTATAGAGGCTCAACAGCATATGTTGAAACTCAC
GGTCTGGGGCATTAAACAGCTCCAGGCAAGAGTCCTGGCCTTGGAAAGATACCTAAAGGATCAACAGCTCCTAGGGA
TGTGGGGCTGCTCTGGAAAACTCATCTGCACCACTAATGTATATTGGAACTCTAGTTGGAGTAATAAAACTTATGGT
GATATTTGGGATAACATGACCTGGATGCAGTGGGAGAGAGAAATTAGCAATTATACAGAAATAATATATGAATTGCT
TGAAGAATCACAAAACCAGCAGGAAAAGAATGAACAAGATTTACTAGCATTGGACAGATGGAACAGTCTGTGGAATT
GGTTTAACATAACAAATTGGCTGTGGTATATAAAAATATTCATAATGATAGTAGGAGGCTTGATAGGTTTAAGAATA
ATTTTTGCTGTGCTTTCTTTAGTAAATAGAGTTAGGCAGGGATACTCACCTCTGTCGTTACAGACCCTTATCCCAAG
CCCGAGGGGACCAGACAGGCCCGGAGGAATCGAAGAGGAAGGTGGAGAGCAAGACAGAAACAGATCAACGCGATTAG
TGAGCGGATTCTTAGCGCTTGCCTGGGACGACCTGCGGAGCCCTGTGCCTTTTCATCTACCACCGATTGAGAGACTTC
ATATTAATTGCAGCGAGAGCGGGGGAACTTCTGGGACGCAGCAGTCTCAAGGGACTACGGAGAGGGTGGGAAGCCCT
TAAGTATCTGGGAAGTCTTGTGCAGTATTGGGGCCTGGAACTAAAAAGGAGTGCTATTAGTCTATTGGATACCCTAG
CAATAGCAGTAGGTGAAGGAACAGATAGGATTCTAGAATTTGTATTAGGAATTTGTAGAGCTATCCGCAACATACCT
ACAAGAATAAGACAGGGCTTTGAAACAGCTTTGCTATAA
>793010505.N53.8
ATGAGAGTGATGGGGATACAAAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
CTGCCAATGCTACTGCCAGCAATAGCAGTATAATAGAGGGAATGAAAAATTGCTCTTTCAATATAACCACAGAATTA
AGAGATAAGAGAGAGAAAAGAATGCACTTTTTTATAAACTTGATATAGTACAACTAGATGGCAACTCTAGTCAGTA
TAGATTAATAAATTGTAATACCTCAGCCATAACACAAGCCTGTCCAAAGGTCTCTTTTGACCCAATTCCTATACATT
ATTGTGCTCCAGCTGGTTATGCGATTCTAAAGTGTAATAATAAGACATTCAATGGAACAGGACCGTGTAATAATGTC
AGCACAGTACAATGTACACATGGAATTAAGCCAGTGGTTTCAACTCAACTATTGTTAAATGGTAGCCTAGCAGAAGG
AGAGATAATAATTAGATCTGAAAATATAACAGACAATGGCAAAACAATAATAGTACATCTCAATGAATCTGTAAAGA
TTGAGTGTACGAGACCCAGTAATAACACAAGAACAAGTATAAGAATAGGACCAGGACAAGCATTTTATGCAACAGGA
CAAGTAATAGGAGACATAAGAGAAGCACATTGTAACATTAGTGAAAGTAAATGGAATGAAACTTTACAAAGGGTAAG
TAAAAAATTAAAAGAATACTTCCCTCAGAAGAATATAACATTTCAACCATCCTCAGGAGGGGACCTAGAAATTACAA
CACATAGCTTTAATTGTGGAGGAGAATTTTCTATTGCAATACATCAAGCCTGTTTAATAGGACATATATGGCTACT
AGTACAGATATGGCTAATAGTACAGAAACTAACAGTACACGAATCATCACAATCCGCTGCAGAATAAAACAAATTAT
AAACATGTGGCAGGAGGTGGGACGAGCAATGTATGCCCCTCCCATTGCAGGAAACATAACATGTATATCAAATATCA
CAGGACTACTATTGACAAGGGATGGGGGAAAAACAATACGGAGACATTCAGACCTGGAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTTGGAAAGATACCTAAAGGATCAACAGCTCCTAGGGATGTGGGGCTGCTCTGGAAAACTCATCTGCA
TCTGCACCACTAATGTATATTGGAACTCTAGTTGGAGTAATAAAACTTATGGTGATATTTGGGATAACATGACCTGG
ATGCAGTGGGAGAGAGAAATTAGCAATTATACAGAACTAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGATGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAAGGAACAG
```

FIG. 17B cont'd

ATAGGATTCTAGAATTTGTATTAGGAATTTGTAGAGCTATCCGCAACATACCTACAAGAATAAGACAGGGCTTTGAA
ACAGCTTTGCTATAA
>703010505.W53.24
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
CTGCCAATGCTACTGCCAGCAATAGCAGTATAATAGAGGGAATGAAAAATTGCTCTTTCAATATAACCACAGAATTA
AGAGATAAGAGAGAGAAAAAGAATGCACTTTTTTATAAACTTGATATAGTACAACTAGATGGCAACTCTAGTCAGTA
TAGATTAATAAATTGTAATACCCTCAGTCATAACACAAGCCTGTCCAAAGGTCTCTTTTGACCCAATTCCTATACATT
ATTGTGCTCCAGCTGGTTATGCGATTCTAAAGTGTAATAATAAGACATTCAATGGAACAGGACCGTGTAATAATGTC
AGCACAGTACAATGTACACATGGAATTAAGCCAGTGGTTTCAACTCAACTATTGTTAAATGGTAGCCTAGCAGAAGG
AGAGATAATAATTAGATCTGAAAACATAACAGACAATGGCAAAACAATAATAGTACATCTCAATGAATCTGTAAAGA
TTGAGTGTACGAGACCCAGTAATAACACAAGAACAAGTATAAGAATAGGACCAGGACAAGCATTTTATGCAACAGGA
CAAGTAATAGGAGACATAAGAGAAGCACATTGTAACATTAGTGAAAGTAAATGGAATGAAACTTTACAAAGGGTAAG
TAAAAAATTAAAAGAATACTTCCCTCATAAGAATATAACATTTCAACCATCCTCAGGAGGGGACCTAGAAATTACAA
CACATAGCTTTAATTGTGGAGGAGAATTTTTCTATTGCAATACATCAAGCCTGTTTAATAGGACATATATGGCTACT
AGTACAGATATGGCTAATAGTACAGAAACTAACAGTACACGAATCATCACAATCCGCTGCAGAATAAAACAAATTAT
AAACATGTGGCAGGAGGTGGGACGAGCAATGTATGCCCCTCCCATTGCAGGAAACATAACATGTATATCAAATATCA
CAGGACTACTATTGACAAGGGATGGAGGAAAAAACAATACGGAGACATTCGAGACATTCAGACCTGGAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGACAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGTTGGAGTAATAAAACTTATGGTGATATTTGGGATAACATGACCTGG
ATGCAGTAGGAGAGAGAAAATTAGCAATTATACAGAAATGATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAGATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGTGAGAGCGGGG
GAACTTCTGGGACGCAGCAGTCTCAAGGGACTACGGAGAGGATGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAAGGAACAG
ATAGGATTCTAGAATTTGTATTAGGAATTTGTAGAGCTATCCGCAACATACCTACAAGAATAAGACAGGGCTTTGAA
ACAGCTTTGCTATAA
>703010505.W53.31
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTAGATCAGATGCATGAAGA
TGTAATTAGTTTATGGGATCAAAGCCTCAAGCCATGTGTAAAGTTGACCCCACTCTGTGTCACTCTAAACTGTACCG
ATGCTACTGCCAGCAATGCTACTGCCAGCAATAGCAGTATAATAGAGGGAATGAAAAATTGC
TCTTTCAATATAACCACAGAATTAAGAGATAAGAGAGAGAAAAAGAATGCACTTTTTTATAAACTTGATATAGTACA
ACTAGATGGCAACTCTAGTCAGTATAGATTAATAAATTGTAATACCCTCAGTCATAACACAAGCCTGTCCAAAGGTCT
CTTTTGACCCAATTCCTATACATTATTGTGCTCCAGCTGGTTATGCGATTCTAAAGTGTAATAATAAGACATTCAAT
GGAACAGGACCGTGTAATAATGTCAGCACAGTACAATGTACACATGGAATTAAGCCAGTGGTTTCAACTCAACTATT
GTTAAATGGTAGCCTAGCAGAAGGAGAGATAATAATTAGATCTGAAAATATAACAGACAATGGCAAAACAATAATAG
TACATCTCAATGAATCTGTAAAGATTGAGTGTACGAGACCCAGTAATAACACAAGAACAAGTATAAGAATAGGACCA
GGACAAGCATTTTATGCAACAGGACAAGTAATAGGAGACATAAGAGAAGCACATTGTAACATTAGTGAAAGTAAATG
GAATGAAACTTTACAAAGGGTAAGTAAAAAATTAAAAGAATACTTCCCTCATAAGAATATAACATTTCAACCATCCT
CAGGAGGGGACCTAGAAATTACAACACATAGTTTTAATTGTGGAGGAGAATTTTTCTATTGCAATACATCAAGCCTG
TTTAATAGGACATATATGGCTAATAGTACAGAAACTAACAGTACACGAATCATCACAATCCGCTGCAGAATAAAACA
AATTATAAACATGTGGCAGGAGGTGGGACGAGCAATGTATGCCCCTCCCATTGCAGGAAACATAACATGTATATCAA
ATATCACAGGACTACTATTGACAAGGGATGGAGGAAATAACAATACGGAGACATTCGAGACCTGGAGGAGGAAATATG
AAGGACAATTGGAGAAGTGAATTATATAAATATAAAGTGGTAGAAGTTAAGCCATTAGGAGTAGCACCCACTAATGC
AAGAAGGAGAGTGGTGGAGAGAGAAAAAAGAGCAGTGGGAATGGGAGCTGTGTTCCTTGGGTTCTTGGGAGCGGCAG
GAAGCACTATGGGCGCAGCATCAATAACGCTGACGGTACAGGCCAGACAATTATTGTCTGGTATAGTGCAACAGCAA
AGCAATTTGCTGAAGGCTATAGGGGCTCAACAGCATATGTTGAAACTCACGGTCTGGGGCATTAAACAGCTCCAGGC
AAGAGTCCTGGCCTTGGAAAGATACCTAAAGGATCAACAGCTCCTAGGGATGTGGGGCTGCTCTGGAAAACTCATCT
GCACCACTAATGTATATTGGAACTCTAGTTGGAGTAATAAAACTTATGGTGATATTTGGGATAACATGACCTGGATG
CAGTGGGAGAGAGAAATTAGCAATTATACAGAAATGATATATGAATTGCTTGAAGAATCACAAAACCAGCAGGAAAA
GAATGAACAAGATTTACTAGCATTGGACAGATGGAACAGTCTGTGGAATTGGTTTAACATAACAAATTGGCTGTGGT
ATATAAAAATATTCATAATGATAGTAGGAGGCTTGATAGGTTTAAGAATAATTTTTGCTGTGCTCTCTTTAGTAAAT
AGAGTTAGGCAGGGATACTCACCTCTGTCATTGCAGACCCCTTATCCCAAGCCCGAGGGGACCAGACAGGCCCGGAGG
AATCGAAGAAGAAGGTGGAGAGCAAGACAGCAAGACAGAAAGATCCATTAGTGCAGGATTCTTAGCGCTTGTCTGGG
ACGACCTGCGGAGCCTGTGCCTTTTCATCTACCACCGATTGAGAGACTTCATATTAATTGCAGCGAGAGCGGGGGAA
CTTCTGGGACGCAGCAGTCTCAAGGGACTACGGAGAGGATGGGAAGCCCTTAAGTATCTGGGAAGTCTTGTGCAGTA
TTGGGGCCTGGAACTAAAAAGGAGTGCTATTAGTCTATTGGATACCCTAGCAATAGCAGTAGGTGAAGGAACAGATA

FIG. 17B cont'd

```
GGATTCTAGAATTTGCATTAGGAATTTGTAGAGCTATCCGCAACATACCTACAAGAATAAGACAGGGCTTTGAAACA
GCTTTGCTATAA
>703010505.W53.9
ATGAGAGTGATGGGGATACAGAGGAATTATCCACAATGGTTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTAATGCTACTGCCAGCAATAGCAGTATAATAGAGGGAATGAATAGCAGTATAATAGAGGGAATGAAAAATTGC
TCTTTCAATATAACCACAGAATTAAGAGATAAGAGAGAGAAAAAGAATGCACTTTTTTATAAACTTGATATAGTACA
ACTAGATGGCAACTCTAGTCAGTATAGATTAATAAATTGTAATACCTCAGTCATAACACAAGCCTGTCCAAAGGTCT
CTTTTGACCCAATTCCTATACATTATTGTGCTCCAGCTGGTTATGCGATTCTAAAGTGTAATAATAAGACATTCAAT
GGAACAGGACCGTGTAATAATGTCAGCACAGTACAATGTACACATGGAATTAAGCCAGTGGTTTCAACTCAACTATT
GTTAAATGGTAGCCTAGCAGAAGGAGAGATAATAATTAGATCTGAAAACATAACAGTACACGAATCATCACAAT
TACATCTCAATGAATCTGTAAAGATTGAGTGTACGAGACCCAGTAATAACACAAGAACAAGTATAAGAATAGGACCA
GGACAAGCATTTTATGCAACAGGACAAGTAATAGGAGACATAAGAGAAGCACATTGTAACATTAGTGAAAGTAAATG
GAATGAAACTTTACAAAGGGTAAGTGAAAAATTAAAAGAATACTTCCCTCATAAGAATATAACATTTCAACCATCCT
CAGGAGGGGACCTAGAAATTACAACACATAGCTTTAATTGTGGAGGAGAATTTTTCTATTGCAATACATCAAGCCTG
TTTAATAGGACATATATGGCTACTAGTACAGATATGGCTAATAGTACAGAAACTAACAGTACACGAATCATCACAAT
CCGCTGCAGAATAAAACAAATTATAAACATGTGGCAGGAGGTGGGACGAGCAATGTATGCCCCTCCCATTGCAGGAA
ACATAACATGTATATCAAATATCACAGGACTACTATTGACAAGGGATGGAGGAAAAAACAATACGGAGACATTCGAG
ACATTCAGACCTGGAGGAGGAAATATGAAGGACAATTGGAGAAGTGAATTATATAAATATAAAGTGGTAGAAGTTAA
GCCATTAGGAGTAGCACCCACTAATGCAAGAAGGAGAGTGGTGGAGAGAGAAAAAAGAGCAGTGGGAATGGGAGCTG
TGTTCCTTGGGTTCTTGGGAGCGGCAGGAAGCACTATGGGCGCAGCATCAATAACGCTGACGGTACAGGCCAGACAA
TTATTGTCTGGTATAGTGCAACAGCAAAGCAATTTGCTGAAGGCTATAGAGGCTCAACGCATATGTTGAAACTCAC
GGTCTGGGGCATTAAACAGCTCCAGGCAAGAGTCCTGGCCTTGGAAAGATACCTAAAGGATCAACAGCTCCTAGGGA
TGTGGGGCTGCTCTGGAAAACTCATCTGCACCACTAATGTATATTGGAACTCTAGTTGGAGTAATAAAACTTATGGT
GATATTTGGGATAACATGACCTGGATGCAGTGGGAGAGAAATTAGCAATTATACAGAAATAATATATGAATTGCT
TGAAGAATCACAAAACCAGCAGGAAAAGAATGAACAAGATTTACTAGCATTGGACAGATGGAACAGTCTGTGGAATT
GGTTTAACATAACAAATTGGCTGTGGTATATAAAAATATTCATAATGATAGTAGGAGGCTTGATAGGTTTAAGAATA
ATTTTTGCTGTGCTTTCTTTAGTAAATAGAGTTAGGCAGGGATACTCACCTCTGTCGTTACAGACCCTTATCCCAAG
CCCGAGGGGACCAGACAGGCCCGGAGGAATCGAAGAAGAAGGTGGAGAGCAAGACAGAAACAGATCAACGCGATTAG
TGAGCGGATTCTTAGCGCTTGCCTGGGACGACCTGCGGAGCCTGTGCCTTTTCATCTACCACCGATTGAGAGACTTC
ATATTAATTGCAGCGAGAGCGGGGGAACTTCTGGGACGCAGCAGTCTCAAGGGACTACGGAGAGGGTGGGAAGCCCT
TAAGTATCTGGGAAGTCTTGTGCAGTATTGGGGCCTGGAACTAAAAAGGAGTGCTATTAGTCTATTGGATACCCTAG
CAATAGCAGTAGGTGAAGGAACAGATAGGATTCTAGAATTTGTATTAGGAATTTGTAGAGCTATCCGCAACATACCT
ACAAGAATAAGACAGGGCTTTGAAACAGCTTTGCTATAA
>703010505.W53.32
ATGAGAGTGATGGGGATACAGAGGAATTATCCACAATGGTTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTAATGCTACTGCCAGCAATAGCAGTATAATAGAGGGAATGAATAGCAGTATAATAGAGGGAATGAAAAATTGC
TCTTTCAATATAACCACAGAATTAAGAGATAAGAGAGAGAAAAAGAATGCACTTTTTTATAAACTTGATATAGTACA
ACTAGATGGCAACTCTAGTCAGTATAGATTAATAAATTGTAATACCTCAGTCATAACACAAGCCTGTCCAAAGGTCT
CTTTTGACCCAATTCCTATACATTATTGTGCTCCAGCTGGTTATGCGATTCTAAAGTGTAATAATAAGACATTCAAT
GGAACAGGACCGTGTAATAATGTCAGCACAGTACAATGTACACATGGAATTAAGCCAGTGGTTTCAACTCAACTATT
GTTAAATGGTAGCCTAGCAGAAGGAGAGATAATAATTAGATCTGAAAACATAATAGACAATGGCAAAACAATAATAG
TACATCTCAATGAATCTGTAAAGATTGAGTGTACGAGACCCAGTAATAACACAAGAACAAGTATAAGAATAGGACCA
GGACAAGCATTTTATGCAACAGGACAAGTAATAGGAGACATAAGAGAAGCACATTGTAACATTAGTGAAAGTAAATG
GAATGAAACTTTACAAAGGGTAAGTGAAAAATTAAAAGAATACTTCCCTCATAAGAATATAACATTTCAACCATCCT
CAGGAGGGGACCTAGAAATTACAACACATAGCTTTAATTGTGGAGGAGAATTTTTCTATTGCAATACATCAAGCCTG
TTTAATAGGACATATATGGCTACTAGTACAGATATGGCTAATAGTACAGAAACTAACAGTACACGAATCATCACAAT
CCGCTGCAGAATAAAACAAATTATAAACATGTGGCAGGAGGTGGGACGAGCAATGTATGCCCCTCCCATTGCAGGAA
ACATAACATGTATATCAAATATCACAGGACTACTATTGACAAGGGATGGAGGAAAAAACAATACGGAGACATTCGAG
ACATTCAGACCTGGAGGAGGAAATATGAAGGACAATTGGAGAAGTGAATTATATAAATATAAAGTGGTAGAAGTTAA
GCCATTAGGAGTAGCACCCACTAATGCAAGAAGGAGAGTGGTGGAGAGAGAAAAAAGAGCAGTGGGAATGGGAGCTG
TGTTCCTTGGGTTCTTGGGAGCGGCAGGAAGCACTATGGGCGCAGCATCAATAACGCTGACGGTACAGGCCAGACAA
TTATTGTCTGGTATAGTGCAACAGCAAAGCAATTTGCTGAAGGCTATAGAGGCTCAACGCATATGTTGAAACTCAC
GGTCTGGGGCATTAAACAGCTCCAGGCAAGAGTCCTGGCCTTGGAAAGATACCTAAAGGATCAACAGCTCCTAGGGA
TGTGGGGCTGCTCTGGAAAACTCATCTGCACCACTAATGTATATTGGAACTCTAGTTGGAGTAATAAAACTTATGGT
GATATTTGGGATAACATGACCTGGATGCAGTGGGAGAGAAATTAGCAATTATACAGAAATAATATATGAATTGCT
TGAAGAATCACAAAACCAGCAGGAAAAGAATGAACAAGATTTACTAGCATTGGACAGATGGAACAGTCTGTGGAATT
GGTTTAACATAACAAATTGGCTGTGGTATATAAAAATATTCATAATGATAGTAGGAGGCTTGATAGGTTTAAGAATA
ATTTTTGCTGTGCTTTCTTTAGTAAATAGAGTTAGGCAGGGATACTCACCTCTGTCGTTACAGACCCTTATCCCAAG
CCCGAGGGGACCAGACAGGCCCGGAGGAATCGAAGAAGAAGGTGGAGAGCAAGACAGAAACAGATCAACGCGATTAG
TGAGCGGATTCTTAGCGCTTGCCTGGGACGACCTGCGGAGCCTGTGCCTTTTCATCTACCACCGATTGAGAGACTTC
ATATTAATTGCAGCGAGAGCGGGGGAACTTCTGGGACGCAGCAGTCTCAAGGGACTACGGAGAGGGTGGGAAGCCCT
TAAGTATCTGGGAAGTCTTGTGCAGTATTGGGGCCTGGAACTAAAAAGGAGTGCTATTAGTCTATTGGATACCCTAG
```

FIG. 17B cont'd

```
CAATAGCAGTAGGTGAAGGAACAGATAGGATTCTAGAATTTGTATTAGGAATTTGTAGAGCTATCCGCAACATACCT
ACAAGAATAAGACAGGGCTTTGAAACAGCTTTGCTATAA
>703010505.W53.21
ATGAGAGTGATGGGGATACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACAGGTGGAAAAATGACATGGTGGATCAGATGCATGAAGA
TGTAATTAGTTTATGGGATCAAAGCCTCAAGCCCTGTGTAAAGTTGACCCCACTCTGTGTCACTCTAAACTGTACCG
ATGCTAATGCTACTGCCAGCAATAGCAGTATAATAGAGGGAATGAAAAATTGCTCTTTCAATATAACCACAGAATTA
AGAGATAAGAGAGAGAAAAAGAATGCACTTTTTTATAAACTTGATATAGTACAACTAGATGGCAACTCTAGTCAGTA
TAGATTAATAAATTGTAATACCCTCAGTCATAACACAAGCCTGTCCAAAGGTCTCTTTTGACCCAATTCCTATACATT
ATTGTGCTCCAGCTGGTTATGCGATTCTAAAGTGTAATAATAAGACATTCAATGGAACAGGACCGTGTAATAATGTC
AGCACAGTACAATGTACACATGGAATTAAGCCAGTGGTTTCAACTCAACTATTGTTAAATGGTAGCCTAGCAGAAGG
AGAGATAATAATTAGATCTGAAAACATAACAGACAATGGCAAAACAATAATAGTACATCTCAATGAATCTGTAAAGA
TTGAGTGTACGAGACCCAGTAATAACACAAGAACAAGTATAAGAATAGGACCAGGACAAGCATTTTATGCAACAGGA
CAAGTAATAGGAGACATAAGAGAAGCACATTGTAACATTAGTGAAAGTAAATGGAATGAAACTTTACAAAGGGTAAG
TAAAAAATTAAAAGAATACTTCCCTCATAAGAATATAAACATTTCAACCATCCTCAGGAGGGGACCTAGAAATTACAA
CACATAGCTTTAATTGTGGAGGAGAATTTTTCTATTGCAATACATCAAGCCTGTTTAATAGGACATATATGGCTAAT
AGTACAGAAACTAACAGTACACGAATCATCACAATCCGCTGCAGAATAAAACAAATTATAAACATGTGGCAGGAGGT
GGGACGAGCAATGTATGCCCCTCCCATTGCAGGAAACATAACATGTATATCAAATATCACAGGACTACTATTGACAA
GGGATGGAGGAAAAAACAATACGGAGACATTCGAGACATTCAGACCTGGAGGAGGAAATATGAAGGACAATTGGAGA
AGTGAATTATATAAATATAAAGTGGTAGAAGTTAAGCCATTAGGAGTAGCACCCACTAATGCAAGAAGGAGAGTGGT
GGAAAGAGAAAAAAGAGCAGTGGGAATGGGAGCTGTGTTCCTTGGGTTCTTGGGCGGCAGGAAGCACTATGGGCG
CAGCATCAATAACGCTGACGGTACAGGCCAGACAATTATTGTCTGGTATAGTGCAACAGCAAAGCAATTTGCTGAAG
GCTATAGAGGCTCAACAGCATATGTTGAAACTCACGGTCTGGGGCATTAAACAGCTCCAGGCAAGAGTCCTGGCCTT
GGAAAGATACCTAAAGGATCAACAGCTCCTAGGGATGTGGGGCTGCTCTGGAAAACTCATCTGCACCACTAATGTAT
ATTGGAACTCTAGTTGGAGTAATAAAACTTATGGTGATATTTGGGATAACATGACCTGGATGCAGTGGGAGAGAGAA
ATTAGCAATTATACAGAAATTATACAGAAGAATCAGCAGGAAAAAGAATGAACAAGATTT
ACTAGCATTGGACAGATGGAACAGTCTGTGGAATTGGTTTAACATAACAAAATGGCTGTGGTATATAAAAATATTCA
TAATGATAGTAGGAGGCTTGATAGGTTTAAGAATAATTTTTTGCTGTGCTCTCTTTAGTAAATAGAGTTAGGCAGGGA
TACTCACCTCTGTCATTGCAGACCCTTATCCCAAGCCCGAGGGGACCAGACAGGCCCGGAGGAATCGAAGAAGAAGG
TGGAGAGCAAGACAGAAACAGATCAACGCGATTAGTGAGCGGATTCTTAGCGCTTGCCTGGGACGACCTGCGGAGCC
TGTGCCTTTTCATCTACCACCGATTGAGAGACTTCATATTAATTGCAGCGAGAGCGGGGGAACTTCTGGGACGCAGC
AATCTCAAGGGACTACGGAGGATGGGAAGCCCTTAAGTATCTGGGAAGTCTTGTGCAGTATTGGGGCCTGGAACT
AAAAAAGGAGTGCTATTAGTCTATTGGATACCCTAGCAATAGCAGTAGGTGAAGGAACAGATAGGATTCTAGAATTTG
TATTAGGAATTTGTAGAGCTATCCGCAACATACCTACAAGAATAAGACAGGGCTTTGAAACAGCTTGCTATAA
>703010505.W53.11
ATGAGAGTGATGGGGATACAGAGGAATTATCCACAATGGTGGATATGGAGCATGTTAGGCTTTTGGATGCTAATGAT
TGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTAATGCTACTGCCAGCAATAGCAGTATAATAGAGGGAATGAATAGCAGTATAATAGAGGGAATGAAAAATTGC
TCTTTCAATATAACCACAGAATTAAGAGATAAGAAGCAGAAGAATGCACTTTTTATAAACTTGATATAGTACA
ACTAGATGGCAACTCTAGTCAGTATAGATTAATAAATTGTAATACCCTCAGTCATAACACAAGCCTGTCCAAAGGTCT
CTTTTGACCCAATTCCTATACATTATTGTGCTCCAGCTGGTTATGCGATTCTAAAGTGTAATAATAAGACATTCAAT
GGAACAGGACCGTGTAATAATGTCAGCACAGTACAATGTACACATGGAATTAAGCCAGTGGTTTCAACTCAACTATT
GTTAAATGGTAGCCTAGCAGAAGGAGAGATAATAATTAGATCTGAAAACATAACAGACAATGGCAAAACAATAATAG
TACATCTCAATGAATCTGTAAAGATTGAGTGTACGAGACCCAGTAATAACACAAGAACAAGTATAAGAATAGGACCA
GGACAAGCATTTTATGCAACAGGACAAGTAATAGGAGACATAAGAGAAGCACATTGTAACATTAGTGAAAGTAAATG
GAATGAAACTTTACAAAGGGTAAGTGAAAAATTAAAAGAATACTTCCCTCATAAGAATATAAACATTTCAACCATCCT
CAGGAGGGGACCTAGAAATTACAACACATAGCTTTAATTGTGGAGGAGAATTTTTCTATTGCAATACATCAAGCCTG
TTTAATAGGACATATATGGCTACTAGTACAGATATGGCTAATAGTACAGAAACTAACAGTACACGAATCATCACAAT
CCGCTGCAGAATAAAACAAATTATAAACATGTGGCAGGAGGTGGGACGAACAATGTATGCCCCTCCCATTGCAGGAA
ACATAACATGTATATCAAATATCACAGGACTACTATTGACAGGACATTCGAG
ACATTCAGACCTGGAGGAGGAAATATGAAGGACAATTGGAGAAGTGAATTATATAAATATAAAGTGGTAGAAGTTAA
GCCATTAGGAGTAGCACCCACTAATGCAAGAAGGAGAGTGGTGGAGAGAGAAAAAAGAGCAGTGGGAATGGGAGCTG
TGTTCCTTGGGTTCTTGGGAGCGGCAGGAAGCACTATGGGCGCAGCATCAATAACGCTGACGGTACAGGCCAGACAA
TTATTGTCTGGTATAGTGCAACAGCAAAGCAATTTGCTGAAGGCTATAGAGGCTCAACAGCATATGTTGAAACTCAC
GGTCTGGGGCATTAAACAGCTCCAGGCAAGAGTCCTGGCCTTGGAAAGATACCTAAAGGATCAACAGCTCCTAGGGA
TGTGGGGCTGCTCTGGAAAACTCATCTGCACCACTAATGTATATTGGAACTCTAGTTGGAGTAATAAAACTTATGGT
GATATTTGGGATAACATGACCTGGATGCAGTGGGAGAGAGAAATTAGCAATTATACAGAAAAATATATGAATTGCT
TGAAGAATCACAAAACCAGCAGGAAAAGAATGAACAAGATTTACTAGCATTGGACAGATGGAACAGTCTGTGGAATT
GGTTTAACATAACAAATTGGCTGTGGTATATAAAAATATTCATAATGATAGTAGGAGGCTTGATAGGTTTAAGAATA
ATTTTTGCTGTGCTTCTTTAGTAAATAGAGTTAGGCAGGGATACTCACCTCTGTCGTTACAGACCCTTATCCCAAG
CCCGAGGGGACCAGACAGGCCCGGAGGAATCGAAGAAGGAAGGTGGAGAGCAAGACAGAGACAGATCAACGCGATTAG
TGAGCGGATTCTTAGCGCTTGCCTGGGACGACCTGCGGAGCCTGTGCCTTTTCATCTACCACCGATTGAGAGACTTC
ATATTAATTGCAGCGAGAGCGGGGAACTTCTGGGACGCAGCAGTCTCAAGGGACTACGGAGAGGGTGGGAAGCCCT
TAAGTATCTGGGAAGTCTTGTGCAGTATTGGGGCCTGGAACTAAAAAGGAGTGCTATTAGTCTATTGGATACCCTAG
```

FIG. 17B cont'd

```
CAATAGCAGTAGGTGAAGGAACAGATAGGATTCTAGAATTTGTATTAGGAATTTGTAGAGCTATCCGCAACATACCT
ACAAGAATAAGACAGGGCTTTGAAACAGCTTTGCTATAA
>703010505.W53.16
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTAATGCTACTGCCAGCAATAGCAGTATAATAGAGGGAATGAATAGCAGTATAATAGAGGGAATGAAAAATTGC
TCTTTCAATATAACCACAGAATTAAGAGATAAGAGAGAGAAAAAGAATGCACTTTTTTATAAACTTGATATAGTACA
ACTAGATGGCAACTCTAGTCAGTATAGATTAATAAATTGTAATACCTCAGTCATAACACAAGCCTGTCCAAAGGTCT
CTTTTGACCCAATTCCTATACATTATTGTGCTCCAGCTGGTTATGCGATTCTAAAGTGTAATAATAAGACATTCAAT
GGAACAGGACCGTGTAATAATGTCAGCACAGTACAATGTACACATGGAATTAAGCCAGTGGTTTCAACTCAACTATT
GTTAAATGGTAGCCTAGCAGAAGGAGAGATAATAATTAGATCTGAAAACATAACAGACAATGGCAAAACAATAATAG
TACATCTCAATGAATCTGTAAAGATTGAGTGTACGAGACCCAGTAATAACACAAGAACAAGTATAAGAATAGGACCA
GGACAAGCATTTTATGCAACAGGACAAGTAATAGGAGACATAAGAGAAGCACATTGTAACATTAGTGAAAGTAAATG
GAATGAAACTTTCACAAAGGGTAAGTGAAAAATTAAAAGAATACTTTCCCTCATAAGAATATAACATTTCAACCATCT
CAGGAGGGGACCTAGAAATTACAACACATAGCTTTAATTGTGGAGGAGAATTTTTCTATTGCAATACATCAAGCCTG
TTTAATAGGACATATATGGCTACTAGTACAGATATGGCTAATAGTACAGAAACTAACAGTACACGAATCATCACAAT
CCGCTGCAGAATAAAACAAATTATAAACATGTGGCAGGAGGTGGGACGAGCAATGTATGCCCCTCCCATTGCAGGAA
ACATAACATGTATATCAAATATCACAGGACTACTATTGACAAGGGATGGAGGAAAAAACAATACGGAGACATTCGAG
ACATTCAGACCTGGAGGAGGAAATATGAAGGACAATTGGAGAAGTGAATTATATAAATATAAAGTGGTAGAAGTTAA
GCCATTAGGAGTAGCACCCACTAATGCAAGGAGGAGAGTGGTGGAGAGAGAAAAAAGAGCAGTGGGAATGGGAGCTG
TGTTCCTTGGGTTCTTGGGAGCGGCAGGAAGCACTATGGGCGCAGCATCAATAACGCTGACGGTACAGGCCAGACAA
TTATTGTCTGGTATAGTGCAACAGCAAAGCAATTTGCTGAAGGCTATAGAGGCTCAACAGCATATGTTGAAACTCAC
GGTCTGGGGCATTAAACAGCTCCAGGCAAGAGTCCTGGCCTTGGAAAGATACCTAAAGGATCAACAGCTCCTAGGGA
TGTGGGGCTGCTCTGGAAAACTCATCTGCACCACTAATGTATATTGGAACTCTAGTTGGAGTAATAAAACTTATGGT
GATATTTGGGATAACATGACCTGGATGCAGTGGGAGAGAGAAATTAGCAATTATACAGAAATAATATATGAACTGCT
TGAAGAATCACAAAACCAGCAGGAAAAGAATGAACAAGATTTACTAGCATTGGACAGATGGAACAGTCTGTGGAATT
GGTTTAACATAACAAATTGGCTGTGGTATATAAAAATATTCATAATGATAGTAGGAGGCTTGATAGGTTTAAGAATA
ATTTTTGCTGTGCTTTCTTTAGTAAATAGAGTTAGGCAGGGATACTCACCTCTGTCGTTACAGACCCTTATCCCAAG
CCCGAGGGGACCAGACAGGCCCGGAGGAATCGAAGAAGAAGGTGGAGAGCAAGACAGAAACAGATCAACGCGATTAG
TGAGCGGATTCTTAGCGCTTGCCTGGGACGACCTGCGGAGCCTGTGCCTTTCATCTACCACCGATTGAGAGACTTC
ATATTAATTGCAGCGAGAGCGGGGGAACTTCTGGGACGCAGCAGTCTCAAGGGACTACGGAGGGGTGGGAAGCCCT
TAAGTATCTGGGAAGTCTTGTGCAGTATTGGGGCCTGGAACTAAAAAGGAGTGCTATTAGTCTATTGGATACCCTAG
CAATAGCAGTAGGTGAAGGAACAGATAGGATTCTAGAATTTGTATTAGGAATTTGTAGAGCTATCCGCAACATACCT
ACAAGAATAAGACAGGGCTTTGAAACAGCTTTGCTATAA
>703010505.W53.4
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGCTAATGCTACTGCCAGCAATAGCAGTATAATAGAGGGAATGAATAGCAGTATAATAGAGGGAATGAAAAATTGC
TCTTTCAATATAACCACAGAATTACAACTAGATGCCAACTCTAGTCAGTATAGATTAATAAAATTGTAATACCTCAGT
CATAACACAAGCCTGTCCAAAGGTCTCTTTTGACCCAATTCCTATACATTATTGTGCTCCAGCTGGTTATGCGATTC
TAAAGTGTAATAATAAGACATTCAATGGAACAGGACCGTGTAATAATGTCAGCACAGTACAATGTACACATGGAATT
AAGCCAGTGGTTTCAACTCAACTATTGTTAAATGGTAGCCTAGCAGAAGGAGAGATAATAATTAGATCTGAAAACAT
AACAGACAATGGCAAAACAATAATAGTACATCTCAATGAATCTGTAAAGATTGAGTGTACGAGACCCAGTAATAACA
CAAGAACAAGTATAAGAATAGGACCAGGACAAGCATTTTATGCAACAGGACAAGTAATAGGAGACATAAGAGAAGCA
CATTGTAACATTAGTGAAAGTAAATGGAATGAAACTTTACAAAGGGTAAGTGAAAAATTAAAAGAATACTTCCCTCA
TAAGAATATAACATTTCAACCATCCTCAGGAGGGGACCTAGAAATTACAACACATAGCTTTAATTGTGGAGGAGAAT
TTTTCTATTGCAATACATCAAGCCTGTTTAATAGGACATATATGGCTACTAGTACAGATATGGCTAATAGTACAGAA
ACTAACAGTACACGAATCATCACAATCCGCTGCAGAATAAAACAAATTATAAACATGTGGCAGGAGGTGGGACGAGC
AATGTATGCCCCTCCCATTGCAGGAAACATAACATGTATATCAAATATCACAGGACTACTATTGACAAGGGATGGAG
GAAAAAACAATACGGAGACATTCGAGACATTCAGACCTGGAGGAGGAAATATGAAGGACAATTGGAGAAGTGAATTA
TATAAATATAAAGTGGTAGAAGTTAAGCCATTAGGAGTAGCACCCACTAATGCAAGAAGGAGAGTGGTGGAGAGAGA
AAAAAGAGCAGTGGGAATGGGAGCTGTGTTCCTTGGGTTCTTGGGAGCGGCAGGAAGCACTATGGGCGCAGCATCAA
TAACGCTGACGGTACAGGCCAGACAATTATTGTCTGGTATAGTGCAACAGCAAAGCAATTTGCTGAAGGCTATAGAG
GCTCAACAGCATATGTTGAAACTCACGGTCTGGGGCATTAAACAGCTCCAGGCAAGAGTCCTGGCCTTGGAAAGATA
CCTAAAGGATCAACAGCTCCTAGGGATGTGGGGCTGCTCTGGAAAACTCATCTGCACCACTAATGTATATTGGAACT
CTAGTTGGAGTAATAAAACTTATGGTGATATTTGGGATAACATGACCTGGATGCAGTGGGAGAGAGAAATTAGCAAT
TATACAGAAATAATATATGAATTGCTTGAAGAATCACAAAACCAGCAGGAAAAGAATGAACAAGATTTACTAGCATT
GGACAGATGGAACAGTCTGTGGAATTGGTTTAACATAACAAATTGGCTGTGGTATATAAAAATATTCATAATGATAG
TAGGAGGCTTGATAGGTTTAAGAATAATTTTTGCTGTGCTTTCTTTAGTAAATAGAGTTAGGCAGGGATACTCACCT
CTGTCGTTACAGACCCTTATCCCAAGCCCGAGGGGACCAGACAGGCCCGGAGGAATCGAAGAAGAAGGTGGAGAGCA
AGACAGAAACAGATCAACGCGATTAGTGAGCGGATTCTTAGCGCTTGCCTGGGACGACCTGCGGAGCCTGTGCCTTT
TCATCTACCACCGATTGAGAGACTTCATATTAATTGCAGCGAGAGCGGGGAACTTCTGGGACGCAGCAGTCTCAAG
GGACTACGGAGGGGGTGGGAAGCCCTTAAGTATCTGAGAAGTCTTGTGCAGTATTGGGGCCTGGAACTAAAAAGGAG
```

FIG. 17B cont'd

```
TGCTATTAGTCTATTGGATACCCTAGCAATAGCAGTAGGTGAAGGAACAGATAGGATTCTAGAATTTGTATTAGGAA
TTTGTAGAGCTATCCGCAACATACCTACAAGAATAAGACAGGGCTTTGAAACAGCTTTGCTATAA
>703010505.W53.13
ATGAGAGTGATGGGGAGACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTACTGCCAGCAATGCTACTGCCAGCAATAGCAGTATAATAGAGGGAATGAATAGTAGTATAATAGAGGGAATG
AAAAATTGCTCTTTCAATATAACCACAGAATTAAGAGATAAGAGAGAGAAAAAGAATGCACTTTTTTATAAACTTGA
TATAGTACAACTAGATGGCAACTCTAGTCAGTATAGATTAATAAATTGTAATACCTCAGTCATAACACAAGCCTGTC
CAAAGGTCTCTTTTGACCCAATTCCTATACATTATTGTGCTCCAGCTGGTTATGCGATTCTAAAGTGTAATAATAAG
ACATTCAATGGAACAGGACCGTGTAATAATGTCAGCACAGTACAATGTACACATGGAATTAAGCCAGTGGTTTCAAC
TCAACTATTGTTAAATGGTAGCCTAGCAGAAGGAGAGATAATAATTAGATCTGAAAACATAACAGACAATGGCAAAA
CAATAATAGTACATCTCAATGAATCTGTAAAGATTGAGTGTACGAGACCCAGTAATAACACAAGAACAAGTATAAGA
ATAGGACCAGGACAAGCATTTTATGCAACAGGACAAGTAATAGGAGACATAAGAGAAGCACATTGTAACATTAGTGA
AAGTAAATGGAATGAAACTTTACAAAGGGTAAGTGAAAAATTAAAAGAATACTTCCCTCATAAGAATATAACATTTC
AACCATCCTCAGGAGGGGACCTAGAAATTACAACACATAGCTTTAATTGTGGAGGAGAATTTTTCTATTGCAATACA
TCAAGCCTGTTTAACAGGACATATATGGCTACTAGTACAGATATGGCTAATAGTACAGAAACTAACAGTACACGAAT
CATCACAATCCGCTGCAGAATAAAACAAATTATAAACATGTGGCAGGAGGTGGGACGAGCAATGTATGCCCCTCCCA
TTGCAGGAAACATAACATGTATATCAAATATCACAGGACTACTATTGACAAGGGATGGAGGAAAAAACAATACGGAG
ACATTCGAGACATTCAGACCTGGAGGAGGAAATATGAAGGACAATTGGAGAAGTGAATTATATAAATATAAAGTGGT
AGAAGTTAAGCCATTAGGAGTAGCACCCACTAATGCAAGAAGGAGAGTGGTGGAGAGAGAAAAAAGAGCAGTGGGAA
TGGGAGCTGTGTTCCTTGGGTTCTTGGGAGCGGCAGGAAGCACTATGGGCGCAGCATCAATAACGCTGACGGTACAG
GCCAGACAATTATTGTCTGGTATAGTGCAACAGCAAAGCAATTTGCTGAAGGCTATAGAGGCTCAACAGCATATGTT
GAAACTCACGGTCTGGGCATTAAACAGCTCCAGGCAAGAGTCCTGGCCTTGGAAAGATACCTAAAGGATCAACAGC
TCCTAGGGATGTGGGGCTGCTCTGGAAAACTCATCTGCACCACTAATGTATATTGGAACTCTAGTTGGAGTAATAAA
ACTTATGGTGATATTTGGGATAACATGACCTGGATGCAGTGGGAGAGAGAAATTAGCGATTATACAGAAATAATATA
TGAATTGCTTGAAGAATCACAAAACCAGCAGGAAAAGAATGAACAAGATTTACTAGCATTGGACAGATGGAACAGTC
TGTGGAATTGGTTTAACATAACAAATTGGCTGTGGTATATAAAAATATTCATAATGATAGTAGGAGGCTTGATAGGT
TTAAGAATAATTTTTGCTGTGCTTTCTTTAGTAAATAGAGTTAGGCAGGGATACTCACCTCTGTCGTTACAGACCCT
TATCCCAAGCCCGAGGGGACCAGACAGGCCCGGAGGAATCGAAGAAGAAGGTGGAGACAAGCAAGACAGAAACAGATCAA
CGCGATTAGTGAGCGGATTCTTAGCGCTTGCCTGGGACGACCTGCGGAGCCTGTGCCTTTTCATCTACCACCGATTG
AGAGACTTCATATTAATTGCAGCGAGAGCGGGGGAACTTCTGGGACGCAGCAGTCTCAAGGGACTACGGAGAGGATG
GGAAGCCCTTAAGTATCTGGGAAGTCTTGTGCAGTATTGGGGCCTGGAACTAAAAAGGAGTGCTATTAGTCTATTGG
ATACCCTAGCAATAGCAGTAGGTGAAGGAACAGATAGGATTCTAGAATTTGTATTAGGAATTTGTAGAGCTATCCGC
AACATACCTACAAGAATAAGACAGGGCTTTGAAACAGCTTTGCTATAA
>703010505.W53.1
ATGAGAGTGATGGGGAGACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTACTGCCAGCAATGCTACTGCCAGCAATAGCAGTATAATAGAGGGAATGAATAGTAGTATAATAGAGGGAATG
AAAAATTGCTCTTTCAATATAACCACAGAATTAAGAGATAAGAGAGAGAAAAAGAATGCACTTTTTTATAAACTTGA
TATAGTACAACTAGATGGCAACTCTAGTCAGTATAGATTAATAAATTGTAATACCTCAGTCATAACACAAGCCTGTC
CAAAGGTCTCTTTTGACCCAATTCCTATACATTATTGTGCTCCAGCTGGTTATGCGATTCTAAAGTGTAATAATAAG
ACATTCAATGGAACAGGACCGTGTAATAATGTCAGCACAGTACAATGTACACATGGAATTAAGCCAGTGGTTTCAAC
TCAACTATTGTTAAATGGTAGCCTAGCAGAAGGAGAGATAATAATTAGATCTGAAAACATAACAGACAATGGCAAAA
CAATAATAGTACATCTCAATGAATCTGTAAAGATTGAGTGTACGAGACCCAGTAATAACACAAGAACAAGTATAAGA
ATAGGACCAGGACAAGCATTTTATGCAACAGGACAAGTAATAGGAGACATAAGAGAAGCACATTGTAACATTAGTGA
AAGTAAATGGAATGAAACTTTACAAAGGGTAAGTGAAAAATTAAAAGAATACTTCCCTCATAAGAATATAACATTTC
AACCATCCTCAGGAGGGGACCTAGAAATTACAACACATAGCTTTAATTGTGGAGGAGAATTTTTCTATTGCAATACA
TCAAGCCTGTTTAACAGGACATATATGGCTACTAGTACAGATATGGCTAATAGTACAGAAACTAACAGTACACGAAT
CATCACAATCCGCTGCAGATAAAACAAATTATAAACATGTGGCAGGAGGTGGGACGAGCAATGTATGCCCCTCCCA
TTGCAGGAAACATAACATGTATATCAAATATCACAGGACTACTATTGACAAGGGATGGAGGAAAAAACAATACGGAG
ACATTCGAGACATTCAGACCTGGAGGAGGAAATATGAAGGACAATTGGAGAAGTGAATTATATAAATATAAAGTGGT
AGAAGTTAAGCCATTAGGAGTAGCACCCACTAATGCAAGAAGGAGAGTGGTGGAGAGAGAAAAAAGAGCAGTGGGAA
TGGGAGCTGTGTTCCTTGGGTTCTTGGGAGCGGCAGGAAGCACTATGGGCGCAGCATCAATAACGCTGACGGTACAG
GCCAGACAATTATTGTCTGGTATAGTGCAACAGCAAAGCAATTTGCTGAAGGCTATAGAGGCTCAACAGCATATGTT
GAAACTCACGGTCTGGGCATTAAACAGCTCCAGGCAAGAGTCCTGGCCTTGGAAAGATACCTAAAGCTCCTAGGGA
TGTGGGGCTGCTCTGGAAAACTCATCTGCACCACTAATGTATATTGGAACTCTAGTTGGAGTAATAAAACTTATGGT
GATATTTGGGATAACATGACCTGGATGCAGTGGGAGAGAGAAATTAGCGATTATACAGAAATAATATATGAATTGCT
TGAAGAATCACAAAACCAGCAGGAAAAGAATGAACAAGATTTACTAGCATTGGACAGATGGTGTGGAATT
GGTTTAACATAACAAATTGGCTGTGGTATATAAAAATATTCATAATGATAGTAGGAGGCTTGATAGGTTTAAGAATA
ATTTTTGCTGTGCTTTCTTTAGTAAATAGAGTTAGGCAGGGATACTCACCTCTGTCGTTACAGACCCTTATCCCAAG
CCCGAGGGGACCAGACAGGCCCGGAGGAATCGAAGAAGAAGGTGGAGAGCAAGACAGAAACAGATCAACGCGATTAG
TGAGCGGATTCTTAGCGCTTGCCTGGGACGACCTGCGGAGCCTGTGCCTTTTCATCTACCACCGATTGAGAGACTTC
ATATTAATTGCAGCGAGAGCGGGGGAACTTCTGGGACGCAGCAGTCTCAAGGGACTACGGAGAGGATGGGAAGCCCT
TAAGTATCTGGGAAGTCTTGTGCAGTATTGGGGCCTGGAACTAAAAAGGAGTGCTATTAGTCTATTGGATACCCTAG
```

FIG. 17B cont'd

CAATAGCAGTAGGTGAAGGAACAGATAGGATTCTAGAATTTGTATTAGGAATTTGTAGAGCTATCCGCAACATACCT
ACAAGAATAAGACAGGGCTTTGAAACAGCTTTGCTATAA
>703010505.W53.28
ATGAGAGTGATGGGGAGACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAAGCCTCAAGCCATGTGTGTAAAGTTGACCCCACTCTGTGTCACTCTAAACTGTACCG
ATGCTACTGCCAGCAATGCTACTGCCAGCAATAGCAGTATAATAGAGCGGAATGAATAGTAGTATAATAGAGGGAATG
AAAAATTGCTCTTTCAATATAACCACAGAATTAAGAGATAAGAGAGAGAAAAAGAATGCACTTTTTTATAAACTTGA
TATAGTACAACTAGATGGCAACTCTAGTCAGTATAGATTAATAAATTGTAATACCTCAGTCATAACACAAGCCTGTC
CAAAGGTCTCTTTTGACCCAATTCCTATACATTATTGTGCTCCAGCTGGTTATGCGATTCTAAAGTGTAATAATAAG
ACATTCAATGGAACAGGACCGTGTAATAATGTCAGCACAGTACAATGTACACATGGAATTAAGCCAGTGGTTTCAAC
TCAACTATTGTTAAATGGTAGCCTAGCAGAAGGAGAGATAATAATTAGATCTGAAAACATAACAGACAATGGCAAAA
CAATAATAGTACATCTCAATGAATCTGTAAAGATTGAGTGTACGAGACCCAGTAATAACACAAGAACAAGTATAAGA
ATAGGACCAGGACAAGCATTTTATGCAACAGGACAAGTAATAGGAGACATAAGAGAAGCACATTGTAACATTAGTGA
AAGTAAATGGAATGAAACTTTACAAAGGGTAAGTGAAAAATTAAAAGAATACTTCCCTCATAAGAATATAACATTTC
AACCATCCTCAGGAGGGGACCTAGAAATTACAACACATAGCTTTAATTGTGGAGGAGAATTTTTCTATTGCAATACA
TCAAGCCTGTTTAACAGGACATATGGCTACTAGTACAGATATGGCTAATAGTACGGAAACTAACAGTACACGAAT
CATCACAATCCGCTGCAGAATAAAACAAATTATAAACATGTGGCAGGAGGTGGGACGAGCAATGTATGCCCCTCCCA
TTGCAGGAAACATAACATGTATATCAAATATCACAGGACTACTATTGACAAGGGATGGAGGAAAAACAATACGGAG
ACATTCAGACATTCAGACCTGGAGGAGGAAATATGAAGGACAATTGGAGAAGTGAATTATATAAATATAAAGTGGT
AGAAGTTAAGCCATTAGGAGTAGCACCCACTAATGCAAGAAGGAGAGTGGTGGAGAGAGAAAAAAGAGCAGTGGGAA
TGGGAGCTGTGTTCCTTGGGTTCTTGGGAGCGGCAGGAAGCACTATGGGCGCAGCATCAATAACGCTGACGGTACAG
GCCAGACAATTATTGTCTGGTATAGTGCAACAGCAAAGCAATTTGCTGAAGGCTATAGAGGCTCAACAGCATATGTT
GAAACTCACGGTCTGGGGCATTAAACAGCTCCAGGCAAGAGTCCTGGCCTTGGAAAAGATACCTAAAGGATCAACAGC
TCCTAGGGATGTGGGGCTGCTCTGGAAAACTCATCTGCACCACTAATGTATATTGGAACTCTAGTTGGAGTAATAAA
ACTTATGGTGATATTTGGGATAACATGACCTGGATGCAGTGGGAGAGAGAAATTAGCGATTATACAGAAATAATATA
TGAATTGCTTGAAGAATCACAAAACCAGCAGGAAAAGAATGAACAAGATTTACTAGCATTGGACAGATGGAACAGTC
TGTGGAATTGGTTTAACATAACAAATTGGCTGTGGTATATAAAAATATTCATAATGATAGTAGGAGGCTTGATAGGT
TTAAGAATAATTTTTGCTGTGTGCTTTCTTTTAGTAAATAGGGTTAGGCAGGGATACTCACCTCTGTCGTTACAGACCCT
TATCCCAAGCCCGAGGGGACCAGACAGGCCCGGAGGAATCGAAGAAGAAGGTGGAGAGCAAGACAGAAACAGATCAA
CGCGATTAGTGAGCGGATTCTTAGCGCTTGCCTGGGACGACCTGCGGAGCCTGTGCCTTTTCATCTACCACCGATTG
AGAGACTTCATATTAATTGCAGCGAGAGCGGGGGAACTTCTGGGACGCAGCAGTCTCAAGGGACTACGGAGAGGATG
GGAAGCCCTTAAGTATCTGGGAAGTCTTGTGCAGTATTGGGGCCTGGAACTAAAAAGGAGTGCTATTAGTCTATTGG
ATACCCTAGCAATAGCAGTAGGTGAAGGAACAGATAGGATTCTAGAATTTGTATTAGGAATTTGTAGAGCTATCCGC
AACATACCTACAAGAATAAGACAGGGCTTTGAAACAGCTTTGCTATAA
>703010505.W78.42
ATGAGAGTGATGGGGGATACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGCGGATCAGATGCATGAAGA
TGTAATTAATTTATGGGATCAAAGCCTCAAGCCATGTGTAAAGTTGACCCCACTCTGTGTCACTCTAAACTGTACCG
ATGCTACTGCCAGCAATGCTACTGCCAGCAATGCTACTGCCAGCAATGCAGTATCAATAGCAGTATAATAGAGGAA
ATGAAAAATTGCTCTTTCAATATAACCACAGAATTAAGAGATAAGAGAGAGAAAAAGAATGCACTTTTTTATAAACT
TGATATAGTACAACTAGATGGCAACTCTAGTCAGTATAGATTAATAAATTGTAATACCTCAGCCATAACACAAGCCT
GTCCAAAGGTATCTTTTGACCCAATTCCTATACATTATTGTGCTCCAGCTGGTTATGCGATTCTAAAGTGTAATAAT
AAGACATTCAATGGAACAGGACCGTGTAATAATGTCAGCACAGTACAATGTACACATGGAATTAAGCCAGTGGTTTC
AACTCAACTATTGTTAAATGGTAGCCTAGCAGAAGGAGATAATAATTAGATCTGAAAATATAACAGACAATGGCA
AAACAATAATAGTACATCTCAATGAATCTGTAAAGATTGAGTGTACGAGACCCAGTAATAACACAAGAACAAGTATA
AGAATAGGACCAGGACAAGCATTTTATGCAACAGGACAAGTAATAGGAGACATAAGAGAAGCACATTGTAACATTAG
TGAAAGTAAATGGAATGAAACTTTACAAAGGGTAAGTAAAAAATTAAAAGAATACTTCCCTCATAAGAATATAACAT
TTCAACCATCCTCAGGAGGGGACCTAGAAGTTACAACACATAGCTTTAATTGTGGAGGAGAATTTTTCTATTGCAAT
ACATCAAGCCTGTTTAATAGGACAGATATGGCTAATAGTACAGAAACTAACAGTACACGAATCATCACAATCCGCTG
CAGAATAAAACAAATTGTAAACATGTGGCAGGAGGTGGGCAGCAGCAATGTATGCCCCTCCCATTGCAGGAAACATAA
CATGTATATCAAATATCACAGGACTACTATTGACAAGGGATGGAGGAGAAAACAATACAGAGACATTCAGACCTGGA
GGAGGAAATATGAAGGACAATTGGAGAAGTGAATTATATAAATATAAAGTGGTAGAAGTTAAGCCATTAGGAGTAGC
ACCCACTAATGCAAGAAGGAGAGTGGTGGAGAGAGAAAAAAGAGCAGTGGGAATGGGAGCTGTGTTCCTTGGGTTCT
TGGGAGCGGCAGGAAGCACTATGGGCGCAGCATCAATAACGCTGACGGTACAGGCCAGACAATTATTGTCTGGTATA
GTGCAACAGCAAAGCAATTTGCTGAAGGCTATAGAGGCTCAACAGCATATGTTGAAACTCACGGTCTGGGGCATTAA
ACAGCTCCAGGCAAGAGTCCTGGCCTTGGAAAAGATACCTAAAGGATCAACAGCTCCTAGGGATGTGGGGCTGCTCT
GGAAAACTCATCTGTACCACTAATGTATATTGGAACTCTAGTTGGAGTAATAAAACTTATGGTGATATTTGGGATAA
CATGACCTGGATGCAGTGGGAGAGAGAAATTAGCAATTATACAGAAATAATATATGAATTGCTTGAAGAATCACAAA
ACCAGCAGGAAAAGAATGAACAAGATTTACTAGCATTGGACAGATGGAACAGTCTGTGGAATTGGTTTAACATAACAA
AATGGCTGTGGTATATAAAAATATTCATAATGATAGTAGGAGGCTTGATAGGTTTAAGAATAATTTTTGCTGTGTGC
TCTCTACTACAGACAGGCCCGGAGGAATCGAAGAAGAAGGTGGAGAGCAAGACAGAAACAGATCAACGCGATTAG
TGAGCGGATTCTTAGCGCTTGCCTGGGACGACCTGCGGAGCCTGTGCCTTTTCATCTACCACCGATTGAGAGACTTC
ATATTAATTGCAGCGAGAGCGGGGGAACTTCTGGGACGCAGCAGTCTCAAGGGACTACGGAGAGGATGGGAAGCCCT
TAAGTATCTGGGAGGTCTTGTGCAGTATTGGGGCCTGGAACTAAAAAGGAGTGCTATTAGTCTATTGGATACCCTAG

FIG. 17B cont'd

CAATAGCAGTAGGTGAAGGAACAGATAGGATTCTAGAATTTGTATTAGGAATTTGTAGAGCTATCCGCAACATACCT
ACAAGAATAAGACAGGGCTTTGAAACAGCTTTGCTATAA
>703010505.W78.6
ATGAGAGTGATGGGGATACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGCGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTACTGCCAGCAATGCTACTGCCAGCAATGCTACTGCCAGCAATAGCAGTATCAATAGCAGTATAATAGAGGAA
ATGAAAAATTGCTCTTTCAATATAACCACAGAATTAAGAGATAAGAGAGAGAAAAAGAATGCACTTTTTTATAAACT
TGATATAGTACAACTAGATGGCAACTCTAGTCAGTATAGATTAATAAATTGTAATACCTCAGCCATAACACAAGCCT
GTCCAAAGGTATCTTTTGACCCAATTCCTATACATTATTGTGCTCCAGCTGGTTATGCGATTCTAAAGTGTAATAAT
AAGACATTCAATGGAACAGGACCGTGTAATAATGTCAGCACAGTACAATGTACACATGGAATTAAGCCAGTGGTTTC
AACTCAACTATTGTTAAATGGTAGCCTAGCAGAAGGAGAGATAATAATTAGATCTGAAAATATAACAGACAATGGCA
AAACAATAATAGTACATCTCAATGAATCTGTAAAGATTGAGTGTACGAGACCCAGTAATAACACAAGAACAAGTATA
AGAATAGGACCAGGACAAGCATTTTATGCAACAGGACAAGTAATAGGAGACATAAGAGAAGCACATTGTAACATTAG
TGAAAGTAAATGGAATGAAACTTTACAAAGGGTAAGTAAAAAATTAAAAGAATACTTCCCTCATAAGAATATAACAT
TTCAACCATCCTCAGGAGGGGACCTAGAAGTTACAACACATAGCTTTAATTGTGGAGGAGAATTTTTCTATTGCAAT
ACATCAAGCCTGTTTAATAGGACAGATATGGCTAATAGTACAGAAACTAACAGTACACGAATCATCACAATCCGCTG
CAGAATAAAACAAATTGTAAACATGTGGCAGGAGGTGGGACGAGCAATGTATGCCCCTCCCATTGCAGGAAACATAA
CATGTATATCAAATATCACAGGACTACTATTGACAAGGGATGGAGGAGAAAACAATGGAGGAAAAAACAATACAGAG
ACATTCAGACCTGGAGGAGGAAATATGAAGGACAATTGGAGAAGTGAATTATATAAATATAAAGTGGTAGAAGTTAA
GCCATTAGGAGTAGCACCCACTAATGCAAGAAGGAGAGTGGTGGAGAGAGAAAAAAGAGCAGTGGGAATGGGAGCTG
TGTTCCTTGGGTTCTTGGGAGCGGCAGGAAGCACTATGGGCGCAGCATCAATAACGCTGACGGTACAGGCCAGACAA
TTATTGTCTGGTATAGTGCAACAGCAAAGCAATTTGCTGAAGGCTATAGAGGCTCAACAGCATATGTTGAAACTCAC
GGTCTGGGGCATTAAACAGCTCCAGGCAAGAGTCCTGGCCTTGGAAAGATACCTAAAGGATCAACAGCTCCTAGGGA
TGTGGGGCTGCTCTGGAAAACTCATCTGTACCACTAATGTATATTGGAACTCTAGTTGGAGTAATAAAACTTATGGT
GATATTTGGGATAACATGACCTGGATGCAGTGGGAGAGAGAAATTAGCAATTATACAGAAATAATATATGAATTGCT
TGAAGAATCACAAAACCAGCAGGAAAAGAATGAACAAGATTTACTAGCATTGGACAGATGGAACAGTCTGTGGAATT
GGTTTAACATAACAAAATGGCTGTGGTATATAAAAATATTCATAATGATAGTAGGAGGCTTGATAGGTTTAAGAATA
ATTTTTGCTGTGCTCTCTTTAGTAAATAGAGTTAGGCAGGGATACTCACCTCTGTCATTGCAGACCCTTATCCCAAG
CCCGAGGGGACCAGACAGGCCCGGAGGAATCGAAGAAGAAGGTGGAGAGCAAGACAGAAACAGATCAACGCGATTAG
TGAGCGGATTCTTAGCGCTTGCCTGGGACGACCTGCGGAGCCTGTGCCTTTTCATCTACCACCGATTGAGAGACTTC
ATATTAATTGCAGCGAGAGCGGGGGAACTTCTGGGACGCAGCAGTCTCAAGGGACTACGGAGAGGATGGGAAGCCCT
TAAGTATCTGGGAGGTCTTGTGCAGTATTGGGGCCTAGAACTAAAAAGGAGTGCTATTAGTCTATTGGATACCCTAG
CAATAGCAGTAGGTGAAGGAACAGATAGGATTCTAGAATTTGTATTAGGAATTTGTAGAGCTATCCGCAACATACCT
ACAAGAATAAGACAGGGCTTTGAAACAGCTTTGCTATAA
>703010505.W78.34
ATGAGAGTGATGGGGATACAGAGGAATTATCCACAATGGTGGATATGGAGCATGTTAGGCTTTTGGACGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGCGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTACTGCCAGCAATGCTACTGCCAGCAATGCTACTGCCAGCAATACTACTGCCAGCAATAGCAATATAATAGAG
GAAATGAAAAATTGCTCTTTCAATATAACCACAGAATTAAGAGATAAGAGAGAGAAAAAGAATGCACTTTTTTATAA
ACTTGATATAGTACAACTAGATGGCAACTCTAGTCAGTATAGATTAATAAATTGTAATACCTCAGTCATAACACAAG
CCTGTCCAAAGGTCTCTTTTGACCCAATTCCTATACATTATTGTGCTCCAGCTGGTTATGCGATTCTAAAGTGTAAT
AATAAGACATTCAATGGAACAGGACCGTGTAATAATGTCAGCACAGTACAATGTACACATGGAATTAAGCCAGTGGT
TTCAACTCAACTATTGTTAAATGGTAGCCTAGCAGAAGGAGAGATAATAATTAGATCTGAAAATATAACAGACAATG
GCAAAACAATAATAGTACATCTCAATGAATCTGTAAAGATTGAGTGTACGAGACCCAGTAATAACACAAGAACAAGT
ATAAGAATAGGACCAGGACAAGCATTTTATGCAACAGGACAAGTAATAGGAGACATAAGAGAAGCACATTGTAACAT
TAGTGAAAGTAAATGGAATGAAACTTTACAAAGGGTAAGCAAAAAATTAAAAGAATACTTCCCTCATAAGAATATAA
CATTTCAACCATCCTCAGGAGGGGACCTAGAAGTTACAACACATAGCTTTAATTGTGGAGGAGAATTTTTCTATTGC
AATACATCAAGCCTGTTTAATAGGACAGATATGGCTAATAGTACAGAAACTAACAGTACACGAATCATCACAATCCG
CTGCAGAATAAAACAAATTGTAAACATGTGGCAGGAGGTGGGACGAGCAATGTATGCCCCTCCCATTGCAGGAAACA
TAACATGTATATCAAATATCACAGGACTACTATTGACAAGGGATGGAGGAGAAAACAATGGAGGAAAAAACAATACA
GAGACATTCAGACCTGGAGGAGGAAATATGAAGGACAATTGGAGAAGTGAATTATATAAATATAAAGTGGTAGAAGT
TAAGCCATTAGGAGTAGCACCCACTAATGCAAGAAGGAGAGTGGTGGAGAGAGAAAAAAGAGCAGTGGGAATGGGAG
CTGTGTTCCTTGGGTTCTTGGGAGCGGCAGGAAGCACTATGGGCGCAGCATCAATAACGCTGACGGTACAGGCCAGA
CAATTATTGTCTGGTATAGTGCAACAGCAAAGCAATTTGCTGAAGGCTATAGAGGCTCAACAGCATATGTTGAAACT
CACGGTCTGGGGCATTAAACAGCTCCAGGCAAGAGTCCTGGCCTTGGAAAGATACCTAAAGGATCAACAGCTCCTAG
GGATGTGGGGCTGCTCTGGAAAACTCATCTGCACCACTAATGTATATTGGAACTCTAGTTGGAGTAATAAAACTTAT
GGTGATATTTGGGATAACATGACCTGGATGCAGTGGGAGAGAGAAATTAGCAATTATACAGAAATAATATATGAATT
GCTTGAAGAATCACAAAACCAGCAGGAAAAGAATGAACAAGATTTACTAGCATTGGACAGATGGAACAGTCTGTGGA
ATTGGTTTAACATAACAAAATGGCTGTGGTATATAAAAATATTCATAATGATAGTAGGAGGCTTGATAGGTTTAAGA
ATAATTTTTGCTGTGCTCTCTTTAGTAAATAGAGTTAGGCAGGGATACTCACCTCTGTCATTGCAGACCCTTATCCC
AAGCCCGAGGGGACCAGACAGGCCCGGAGGAATCGAAGAAGAAGGTGGAGAGCAAGACAGAGACAGATCAACGCGAT
TAGTGAGCGGATTCTTAGCGCTTGCCTGGGACGACCTGCGGAGCCTGTGCCTTTTCATCTACCACCGATTGAGAGAC
TTCATATTAATTGCAGCGAGAGCGGGGGAACTTCTGGGACGCAGCAGTCTCAAGGGACTACGGAGAGGCTGGGAAGC
CCTTAAGTATCTGGGAGGTCTTGTGCAGTATTGGGGCCTAGAACTAAAAAGGAGTGCTATTAGTCTATTGGATACCC

FIG. 17B cont'd

```
TAGCAATAGCAGTAGGTGGAGGAACAGATAGGATTCTAGAATTTGTATTAGGAATTTGTAGAGCTATCCGCAACATA
CCTACAAGAATAAGACAGGGCTTTGAAACAGCTTTGCTATAA
>703010505.W78.16
ATGAGAGTGATGGGGATACAGAGCAATTATCCACAATGGTGGATATGGAGCATGTTAGGCTTGTGGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGCAGATCAGATGCATGAAGA
TGTAATTAGTTTATGGGATCAAAGCCTCAAGCCATGTGTAAAGTTGACCCCACTCTGTGTCACTCTAAACTGTACCG
ATGCTACTACCAATGCTACTGCCAGCAATGCTACTGCCAGCAATGCTACTGCCAGCAATAGCAGTATAATAGAGGGA
ATGAAAAATTGCTCTTTCAATATAACCACAGAATTAGAGATAAGACAGAGAAAAAGAATGCACTTTTTTATAAACT
TGATATAGTACAACTAGATGGCAACTCTAGTCAGTATAGATTAATAAATTGTAATACCTCAGTCATAACACAAGCCT
GTCCAAAGGTCTCTTTTGACCCAATTCCTATACATTATTGTGCTCCAGCTGGTTATGCGATTCTAAAGTGTAATAAT
AAGACATTCAATGGAACAGGACCGTGTAATAATGTCAGCACAGTACAATGTACACATGGAATTAAGCCAGTGGTTTC
AACTCAACTATTGTTAAATGGTAGCCTAGCAGAAGGAGAGATAATAATTAGATCTGAAAATATAACAGACAATGGCA
AAACAATAATAGTACATCTCAATGAATCTGTAAAGATTGAGTGTACGAGACCCAGTAATAACACAAGAACAAGTATA
AGAATAGGACCAGGACAGCATTTTATGCAACAGGACAAGTAATAGGAGACATAAGAGAAGCACATTGTAACATTAG
TGAAAGTAAATGGAATGAAACTTTACAAAGGGTAAGTAAAAAATTAAAAGAATACTTCCCTCATAAGAATATAACAT
TTCAACCATCCTCAGGAGGGGACCTAGAAGTTACAACACATAGCTTTAATTGTGGAGGAGAATTTTTCTATTGCAAT
ACATCAAGCCTGTTTAATAGGACAGATATGGCTAATAGTACAGAAACTAACAGTACACGAATCATCACAATCCGCTG
CAGAATAAAACAAATTATAAACATGTGGCAGGAGGTGGGACGAGCAATGTATGCCCCTCCCATTGCAGGAAACATAA
CATGTATATCAAATATCACAGGACTACTATTGACAAGGGATGGAGGAAAAAACAATGAAGGAAAAAACAATACAGAG
ACATTCAGACCTGGAGGAGGAAATATGAAGGACAATTGGAGAAGTGAATTATATAAATATAAAGTGGTAGAAGTTAA
GCCATTAGGAGTAGCACCCACTAATGCAAGAAGGAGAGTGGTGGAGAGAGAAAAAAGAGCAGTGGGAATGGGAGCTG
TGTTCCTTGGGTTCTTGGGAGCGGCAGGAAGCACTATGGGCGCAGCATCAATAACGCTGACGGTACAGGCCAGACAA
TTATTGTCTGGTATAGTGCAACAGCAAAGCAATTTGCTGAAGGCTATAGAGGCTCAACAGCATATGTTGAAACTCAC
GGTCTGGGGCATTAAACAGCTCCAGGCAAGAGTCCTGGCCTTGGAAAGATACCTAAAGGATCAACAGCTCCTAGGGA
TGTGGGGCTGCTCTGGAAAACTCATCTGCACCAATGTATATTGGAACTCTAGTTGGAGTAATAAAACTTATGGT
GATATTTGGGATAACATGACCTGGATGCAGTGGGAGAGAGAAATTAGCAATTATACAGAAATAATATATGACTTGCT
TGAAGAATCACAAAACCAGCAGGAAAAGAATGAACAAGATTTACTAGCATTGGACAAATGGAACAGTCTGTGGAATT
GGTTTAACATAACAAAATGGCTGTGGTATATAAAAATATTCATAATGATAGTAGGAGGCTTGATAGGTTTAAGAATA
ATTTTTGCTGTGCTTTCTTTAGTAAATAGAGTTAGGCAGGGATACTCACCTCTGTCGTTGCAGACCCTTATCCCAAG
CCCGAGGGGACCAGACAGGCCCGGAGGAATCGAAGAAGAAGGTGGAGAGCAAGACAGAGACAGATCAACGCGATTAG
TGAGCGGATTCTTAGCGCTTGCCTGGGACGACCTGCGGAGCCTGTGCCTTTTCATCTACCACCGATTGAGAGACTTC
ATATTAATTGCAGTGAGAGCGGGGGAACTTCTGGAACGCAGCAGTCTCAAGGGACTACGGAGAGGATGGGAAGCCCT
TAAGTATCTGGGAGGTCTTGTGCAGTATTGGGGCCTGGAACTAAAAAGGAGTGCTATTAGTCTATTAGATACCCTAG
CAATAGCAGTAGGTGAAGGAACAGATAGGATTCTAGAATTTGTATTAGGAATTTGTAGAGCTATCCGCAACATACCT
ACAAGAATAAGACAGGGCTTTGAAACAGCTTTGCTATAA
>703010505.W78.36
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTAGATCAGATGCATGAAGA
TGTAATTAGTTTATGGGATCAAAGCCTCACGCCATGTGTAAAGTTGACCCCACTCTGTGTCACTCTAAACTGTACCG
ATGCTACTGCCAGCAATGCTACTGCCAGCAATGCTACTGCCAGCAATGCTACTGCCAGCAGTAGCAGTATAATAGAG
GAAATGAAAAATTGCTCTTTCAATATAACCACAGAATTAAGAGATAAGAGAGAGAAAAAGAATGCACTTTTTTATAA
ACTTGATATAGTACAACTAGATGGCAACTCTAGTCAGTATAGATTAATAAATTGTAATACCTCAGTCATAACACAAG
CCTGTCCAAAGGTCTCTTTTGACCCAATTCCTATACATTATTGTGCTCCAGCTGGTTATGCGATTCTAAAGTGTAAT
AATAAGACATTCAATGGAACAGGACCGTGTAATAATGTCAGCACAGTACAATGTACACATGGAATTAAGCCAGTGGT
TTCAACTCAACTATTGTTAAATGGTAGCCTAGCAGAAGGAGAGATAATAATTAGATCTGAAAATATAACAGACAATG
GCAAAACAATAATAGTACATCTCAATGAATCTGTAAAGATTGAGTGTACGAGACCCAGTAATAACACAAGAACAAGT
ATAAGAATAGGACCAGGACAAGCATTTTATGCAACAGGACAAGTAATAGGAGACATAAGAGAAGCACATTGTAACAT
TAGTGAAAGTAAATGGAATGAAACTTTACAAAGGGTAAGTAAAAAATTAAAAGAATACTTCCCTCATAAGAATATAA
CATTTCAACCATCCTCAGGAGGGGACCCAGAAATTACAACACATAGCTTTAATTGTGGAGGAGAATTTTTCTATTGC
AATACATCAAGCCTGTTTGATAGGACATATATGGCTAATAGTACAGAAACTAACAGTACACGAATCATCACAATCCG
CTGCAGAATAAAACAAATTATAAACATGTGGCAGGAGGTGGGACGAGCAATGTATGCCCCTCCCATTGCAGGAAACA
TAACATGTATATCAAATATCACAGGACTACTATTGACAAGGGATGGAGGAAACAGCAGTACGGAGACATTCAGACCT
GGAGGAGGAAATATGAAGGACAATTGGAGAAGTGAATTATATAAATATAAAGTGGTAGAAGTTAAGCCATTAGGAGT
AGCACCCACTAATGCAAGAAGGAGAGTGGTGGAGAGAGAAAAAAGAGCAGTGGGAATGGGAGCTGTGTTCCTTGGGT
TCTTGGGAGCGGCAGGAAGCACTATGGGCGCAGCATCAATAACGCTGACGGTACAGGCCAGACAATTATTGTCTGGT
ATAGTGCAACAGCAAAGCAATTTGCTGAAGGCTATAGAGGCTCAACAGCATATGTTGAAACTCACGGTCTGGGGCAT
TAAACAGCTCCAGGCAAGAGTCCTGGCCTTGGAAAGATACCTAAAGGATCAACAGCTCCTAGGGATGTGGGGCTGCT
CTGGAAAACTCATCTGCACCACTAATGTATATTGGAACTCTAGTTGAGTAATAAAACTTATGGTGATATTTGGGAT
AACATGACCTGGATGCAGTGGGAGAGAGAAATTAGCAATTATACAGACATAATATATGAATTGCTTGAAGAATCACA
AAACCAGCAGGAAAAGAATGAACAAGATTTACTAGCATTGGACAGATGGAACAGTCTGTGGAATTGGTTTAACATAA
CAAAGTGGCTGTGGTATATAAAAATATTCATAATGATAGTAGGAGGCTTGATAGGTTTAAGAATAATTTTTGCTGTG
CTTTCTTTAGTAAATAGAGTTAGGCAGGGATACTCACCTCTGTCATTGCAGACCCTTATCCCAAGCCCGAGGGGACC
AGACAGGCCCGGAGGAATCGAAGAAGAAGGTGGAGAGCAAGACAGAAACAGATCAACGCGATTAGTGAGCGGATTCT
TAGCGTTTGCCTGGGACGACCTGCGGAGCCTGTGCCTTTTCATCTACCACCGATTGAGAGACTTCATATTAATTGCA
GCGAGAGCGGGGGAACTTCTGGGACGCAGCAGTCTCAAGGGACTACGGAGGGGATGGGAAGCCCTTAAGTATTTGGG
AGGTCTTGTGCAGTATTGGGGCCTGGAACTAAAAAAGAGTGCTATTAGTCTATTGGATACCCTAGCAATAGCAGTAG
```

FIG. 17B cont'd

```
GTGAAGGAACAGATAGGATTCTAGAATTTGTATTAGGAATTTGTAGAGCTATCCGCAACATACCTACAAGAACAAGA
CAGGGCTTTGAAACAGCTTTGCTATAA
>793010505.W78.32
ATGAGAGTGATGGGGAGACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCACGCCATGTGTAAAGTTGACCCCACTCTGTGTGCACTCTAAACTGTACCG
ATGCTACTGCCAGCAATGCTACTGCCAGCAATGCTACTGCCAGCAATGCTACTGCCAGCAATAGCAGTATAATAATA
GAGGGAATGAAAAATTGCTCTTTCAATATAACCACAGAATTAAGAGATAAGAGAGAGAAAAAGAATGCACTTTTTTA
TAAACTTGATATATAGTACAACTAGATGCAACTCTAGTCAGTATAGATTAATAAAATTGTAATACCTCAGTCATAACAC
AAGCCTGTCCAAAGGTCTCTTTTGACCCAATTCCTATACATTATTGTGCTCCAGCTGGTTATGCGATTCTAAAGTGT
AATAATAAGACATTCAATGGAACAGGACCGTGTAATAATGTCAGCACAGTACAATGTACACATGGAATTAAGCCAGT
GGTTTCAACTCAACTATTGTTAAATGCTAGCCTAGCAGAAGGAGAGATAATAATTAGATCTAAAAATATAACAGACA
ATGGCAAAACAATAATAGTACATCTCAATGAATCTGTAAAGATTGAGTGTACGAGACCCAGTAATAACACAAGAACA
AGTATAAGAATAGGACCAGGACAAGCATTTTATGCAACAGGACAAGTAATAGGAGACATAAGAGAAGCACATTGTAA
CATTAGTGAAAGTAAATGGAATGAAACTTTACAAAGGGTAAGTGAAAAATTAAAAGAATACTTCCCTAATAAGAATA
TAACATTTCAACCATCCTCAGGAGGGGACCTAGAAATTACAACACATAGCTTTAATTGTGGAGGAGAATTTTTCTAT
TGCAATACATCAAGCCTGTTTAATAGGACATATATGGCTAATAGTACAGAAACTAACAGTACACGAATCATCACAAT
CCGCTGCAGAATAAAACAAATTATAAACATGTGGCAGGAGGTGGGACGAGCAATGTATGCCCCTCCCATTGCAGGAA
ACATAACATGTATATCAAATATCACAGGACTACTATTGACAAGGGATGGAGGAAAAAACAATACGGAGACATTCGAG
ACATTCAGACCTGGAGGAGGAAATATGAAGGACAATTGGAGAAGTGAATTATATAAATATAAAGTGGTAGAAGTTAA
GCCATTAGGAGTAGCACCCACTAATGCAAGAAGGAGAGTGGTGGAGAGAGAAAAAAGAGCAGTGGGAATGGGAGCTG
TGTTCCTTGGGTTCTTGGGAGCGGCAGGAAGCACTATGGGCGCAGCATCAATAACGCTGACGGTACAGGCCAGACAA
TTATTGTCTGGTATAGTGCAACAGCAAAGCAATTTGCTGAAGGCTATAGAGGCTCAACAGCATATGTTGAGACTCAC
GGTCTGGGGCATTAAACAGCTCCAGGCAAGAGTCCTGGCCTTAGAAAGATACCTAAAGGATCAACAGCTCCTAGGGA
TGTGGGGCTGCTCTGGAAAACTCATCTGCACCACTAATGTATATTGGAACTCTAGTTGGAGTAATAAAACTTATGGT
GATATTTGGGATAACATGACCTGGATGCAGTGGGAGAGAGAAATTAGCAATTATACAGAAACAATATATGAATTGCT
TGAAGAATCACAAAACCAGCAGGAAAAGAATGAACAAGATTTACTAGCATTGGACAGATGGAACAGTCTGTGGAATT
GGTTTAACATAACAAAGTGGCTGTGGTATATAAAAATATTCATAATGATAGTAGGAGGCTTGATAGGTTTAAGAATA
ATTTTTGCTGTACTTTCTTTAGTAAATAGAGTTAGGCAGGGATACTCACCTCTGTCGTTGCAGACCCTTATCCCAAG
CCCGAGGGGACCAGACAGGCCCGGAGGAATCGAAGAAGAAGGTGGAGAGCAAGACAGAAAGAGATCAACGCGATTAG
TGAGCGGATTCTTAGCGCTTGTCTGGGACGACCTGCGGAGCCTGTGCCTTTTCATCTACCACCGATTGAGAGACTTC
ATATTAATTGCAGCGAGAGCGGGGGAACTTCTGGGACGCAGCAGTCTCAAGGGACTACGGAGAGGGTGGGAAGCCCT
TAAGTATCTGGGAAGTCTTGTGCAGTATTGGGGCCTGGAACTAAAAAGGAGTGCTATTAGTCTATTGGATACCCTAG
CAATAGCCAGTAGGTGAACAGATAGGATTCTAGAATTTGTATTAGGAATTTGTAGAGCTATCCGCAACATACCT
ACAAGAATAAGACAGGGCTTTGAAACAGCTTTGCTATAA
>793010505.W78.41
ATGAGAGTGATGGGGATACAGAGGAATTATCCACAATGGTGGATATGGGGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGCAGATCAGATGCATGAAGA
TGTAATTAGTTTATGGGATCAAAGCCTCAAGCCATGTGTAAAGTTGACCCCACTCTGTATCACTCTAAACTGTACCG
ATGCTACTGCCAGCAATGCTACTGCCAGCAATGCTACTGCCAGCAATGCTACTGCCAGCAGTATAATAGAGGGAATG
AAAAATTGCTCTTTCAATATAACCACAGAATTAAGAGATAAGATAGAGAAAAGGAATGCACTTTTTTATAAACTTGA
TATAGTACAACTAGATGGCAACTCTAGTCAGTATAGATTAATAAATTGTAATACCTCAGTCATAACAAGCCTGTC
CAAAGGTCTCTTTTGACCCAATTCCTATACATTATTGTGCTCCAGCTGGTTATGCGATTCTAAAGTGTAATAATAAG
ACATTCAATGGAACAGGACCGTGTAATAATGTCAGCACAGTACAATGTACACATGGAATTAAGCCAGTGGTTTCAAC
TCAACTATTGTTAAATGGTGGCCTAGCAGAAGGAGAGATAATAATTAGATCTGAAAATATAACAGACAATGGCAAAA
CAATAATAGTACATCTCAATGAATCTGTAAAGATTGAGTGTACGAGACCCAGTAATAACACAAGAACAAGTATAAGA
ATAGGACCAGGACAAGCATTTTATGCAACAGGACAAGTAATAGGAGACATAAGACAAGCACATTGTAACATTAGTGA
AGTAAATGGAATGAAACTTTACAAAGGGTAAGTGAAAAATTAAAAGAATACTTCCCTAATAAGAATATAACATTTC
AACCATCCTCAGGAGGGGACCTAGAAATTACAACACATAGCTTTAATTGTGGAGGAGAATTTTTCTATTGCAATACA
TCAAGCCTGTTTAATAGGACATATATGGCTAATAGTACAGATATGGCTAATAGTACAGAAACTAACAGTACACGAAT
CATCACAATCCGCTGCAGAATAAAACAAATTATAAACATGTGGCAGGAGGTGGGACGAGCAATGTATGCCCCTCCCA
TTGCAGGAAACATAACATGTATATCAAATATCACAGGACTACTATTGACAACGGATGGAGGAAAAAACAATACGGAG
ACATTCGAGACATTCAGACCTGAAGGAGGAAATATGAAGGACAATTGGAGAAGTGAATTATATAAATATAAAGTGGT
AGAAGTTAAGCCATTAGGAGTAGCACCCACTAATGCAAGAAGGAGAGTGGTGGAGAGAGAAAAAAGAGCAGTGGGAA
TGGGAGCTGTGTTCCTTGGGTTCTTGGGAGCGGCAGGAAGCACTATGGGCGCAGCATCAATAACGCTGACGGTACAG
GCCAGACAATTATTGTCTGGTATAGTGCAACAGCAAAGCAATTTGCTGAAGGCTATAGAGGCTCAACAGCATATGTT
GAAACTCACGGTCTGGGGCATTAAACAGCTCCAGGCAAGAGTCCTGGCCTTGGAAAGATACCTAAAGGATCAACAGC
TCCTAGGGATGTGGGGCTGCTCTGGAAAACTCATCTGCACCACTAATGTATATTGGAACTCTAGTTGGAGTAATAAA
ACTTATGGTGATATTTGGGATAACATGACCTGGATGCAGTGGGAGAGAGAAATTAGCAATTATACAGAAATGATATA
TGAATTGCTTGAAGAATCACAAAACCAGCAGGAAAAGAATGAACAAGATTTACTAGCATTGGACAGATGGAACAGTC
TGTGGAATTGGTTTAACATAACAAAGTGGCTGTGGTATATAAAAATATTCATAATGATAGTAGGAGGCTTGATAGGT
TTAAGAATAATTTTTGCTGTGTGCTTTCTTTTAGTAAATAGAGTTAGGCAGGGATACTCACCTCTGTCGTTGCAGACCCT
TATCCCAAGCCCGAGGGGACCAGACAGGCCCGGAGGAATCGAAGAAGAAGGTGGAGAGCAAGACAGAGAGATCAA
CGCGATTAGTGAGCGGATTCTTAGCGCTTGTCTGGGACGACCTGCGGAGCCTGTGCCTTTTCATCTACCACCGATTG
AGAGACTTCATATTAATTGCAGCGAGAGCGGGGGAACTTCTGGGACGCAGCAGTCTCAAGGGACTACGGAGAGGGTG
GGAAGCCCTTAAGTATCTGGGAAGTCTTGTGCAGTATTGGGGCCTGGAACTAAAAAGGAGTGCTATTAGTCTATTGG
```

FIG. 17B cont'd

```
ATACCCTAGCAATAGCAGTAGGTGAAGGAACAGATAGGATTCTAGAATTTGTATTAGGAATTTGTAGAGCTATCCGC
AACATACCTACAAGAATAAGACAAGGCTTTGAAACAGCTTTGCTATAA
>703010505.W78.4
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTACTGCCAGCAATGCTACTGCCAGCAATGCTACTGCCAGCAATGCTACTGCCAGCAATAGCAGTATATTAGAG
GGAATGAAAAATTGCTCTTTTCAATATAACCACAGAATTAAGAGATAAGAGAGAGAAAAAGAATGCACTTTTTTATAA
ACTTGATATAGTACAACTAGGTGGCAACTCTAGTCAGTATAGATTAATAAATTGTAATACCTCAGTCATAACACAAG
CCTGTCCAAAGGTCTCTTTTGACCCAATTCCTATACATTATTGTGCTCCAGCTGGTTATGCGATTCTAAAGTGTAAT
AATAAGACATTCAATGGAACAGGACCGTGTAATAATGTCAGCACAGTACAATGTACACATGGAATTAAGCCAGTGGT
TTCAACTCAACTATTGTTAAATGGTAGCCTAGCAGAAGGAGAGATAATAATTAGATCTAAAAATATAACAGACAATG
GCAAAACAATAATAGTACATCTCAATGAATCTGTAAAGATTGAGTGTACGAGACCCAGTAATAACACAAGAACAAGT
ATAAGAATAGGACCAGGACAAGCATTTTATGCAACAGGACAAGTAATAGGAGACATAAGAGAAGCACATTGTAACAT
TAGTGAAAGTAAATGGAATGAAACTTTACAAAGGGTAAGTGAAAAATTAAAAGAATACTTCCCTCAGAAGAATATAA
CATTTCAACCATCCTCAGGAGGGGACCTAGAAATTACAACACATAGCTTTAATTGTGGAGGAGAATTTTTCTATTGC
AATACATCAAGCCTGTTTAATAGAACATATATGGCTACTAGTACAGATATGGCTAATAGTACAGAAACTAACAGTAC
ACGAATCATCACAATCCGCTGCAGAATAAAACAAATTATAAACATGTGGCAGGAGGTGGGACGAGCAATGTATGCCC
CTCCCATTGCAGGAAACATAACATGTATATCAAATATCCAGGCAGACTACTATTGACAAGGGATGGAGGAAAAACAAT
ACGGAGACATTCGAGACATTCAGACCTGGAGGAGGAAATATGAAGGACAATTGGAGAAGTGAATTATATAAATATAA
AGTGGTAGAAGTTAAGCCATTAGGAGTAGCACCCACTAATGCAAGAAGGAGAGTGGTGGAGAGAGAAAAAAGAGCAG
TGGGAATGGGAGCTGTGTTCCTTGGGTTCTTGGGAGCGGCAGGAAGCACTATGGGCGCAGCATCAATAACGCTGACG
GTACAGGCCAGACAATTATTGTCTGGTATAGTGCAACAGCAAAGCAATTTGCTGAAGGCTATAGAGGCTCAACAGCA
TATGTTGAAACTCACGGTCTGGGGCATTAAACAGCTCCAGGCAAGAGTCCTGGCCTTGGAAAGATACCTAAAGGATC
AACAGCTCCTAGGGATGTGGGGCTGCTCTGGAAAACTCATCTGCACCACTAATGTATATTGGAACTCTAGTTGGAGT
AATAAAACTTATGGTGATATTTGGGATAACATGACCTGGATGCAGTGGGAGAGAGAAATTAGCAATTATACAGAAAC
AATATATGAATTGCTTGAAGAATCACAAAACCAGCAGGAAAAGAATGAACAAGATTTACTAGCATTGGACAGATGGA
ACAGTCTGTGGAATTGGTTTAACATAACAAATTGGCTGTGGTATATAAAAATATTCATAATGATAGTAGGAGGCTTG
ATAGGTTTAAGAATAATTTTTGCTGTGCTTTCTTTAGTAAATAGAGTTAGGCAGGGATACTCACCTCTGTCATTGCA
GACCCTTATCCCAAGCCCGAGGGGACCAGACAGGCCCGGAGGAATCGAAGAAGAAGGTGGAGACAAGACAGAAACA
GATCAACGCGATTAGTGAGCGGATTCTTAGCGCTTGCCTGGGACGACCTGCGGAGCCTGTGCCTTTCATCTACCAC
CGATTGAGAGACTTCATATTAATTGCAGCGAGAGCGGGGGAACTTCTGGGACGCAGCAGTCTCAAGGGACTACGGAG
AGGGTGGGAAGCCCTTAAGTATCTGGGAAGTCTTGTGCAGTATTGGGGCCTGGAACTAAAAAGGAGTGCTATTAGTC
TATTGGATACCCTAGCAATAGCAGTAGGTGAAGGAACAGATAGGATTCTAGAATTTGTATTAGGAATTTGTAGAGCT
ATCCGCAACATACCTACAAGAATAAGACAGGGCTTTGAAACAGCTTTGCCATAA
>703010505.W78.25
ATGAGAGTGATGGGGAGACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCACGCCATGTGTAAAGTTGACCCCACTCTGTGTCACTCTAAACTGTACCG
ATGCTACTGCCAGCAATGCTACTGCCAGCAATGCTACTGCCAGCAATGCTACTGCCAGCAATAGCAGTATAATAATA
GAGGGAATGAAAAATTGCTCTTTCAATATAACCACAGAATTAAGAGATAAGAGAGAGAAAAAGAATGCACTTTTTTA
TAAACTTGATATAGTACAACTAGATGGCAACTCTAGTCAGTATAGATTAATAAATTGTAATACCTCAGTCATAACAC
AAGCCTGTCCAAAGGTCTCTTTTGACCCAATTCCTATACATTATTGTGCTCCAGCTGGTTATGCGATTCTAAAGTGT
AATAATAAGACATTCAATGGAACAGGACCGTGTAATAATGTCAGCACAGTACAATGTACACATGGAATTAAGCCAGT
GGTTTCAACTCAACTATTGTTAAATGGTAGCCTAGCAGAAGGAGAGATAATAATTAGATCTAAAAATATAACAGACA
ATGGCAAAACAATAATAGTACATCTCAATGAATCTGTAAAGATTGAGTGTACGAGACCCAGTAATAACACAAGAACA
AGTATAAGAATAGGACCAGGACAAGCATTTTATGCAACAGGACAAGTAATAGGAGACATAAGAGAAGCACATTGTAA
CATTAGTGAAAGTAAATGGAATGAAACTTTACAAAGGGTAAGTGAAAAATTAAAAGAATACTTCCCTAATAAGAATA
TAACATTTCAACCATCCTCAGGAGGGGACCTAGAAATTACAACACATAGCTTTAATTGTGGAGGAGAATTTTTCTAT
TGCAATACATCAAGCCTGTTTAATAGGACATATATGGCTAATAGTACAGATATGGCTAATAGTACAGAAACTAACAG
TACACGAATCATCACAATCCGCTGCAGAATAAAACAAATTATAAACATGTGGCAGGAGGTGGGACGAGCAATGTATG
CCCCTCCCATTGCAGGAAACATAACATGTATATCAAATATCCACAGGACTACTATTGACAAGGGATGGAGGAAAAAAC
AATACGGAGACATTCGAGACATTCAGACCTGGAGGAGGAAATATGAAGGACAATTGGAGAAGTGAATTATATAAATA
TAAAGTGGTAGAAGTTAAGCCATTAGGAGTAGCACCCACTAATGCAAGAAGGAGAGTGGTGGAGAGAGAAAAAAGAG
CAGTGGGAATGGGAGCTGTGTTCCTTGGGTTCTTGGGAGCGGCAGGAAGCACTATGGGCGCAGCATCAATAACGCTG
ACGGTACAGGCCAGACAATTATTGTCTGGTATAGTGCAACAGCAAAGCAATTTGCTGAAGGCTATAGAGGCTCAACA
GCATATGTTGAAACTCACGGTCTGGGGCATTAAACAGCTCCAGGCAAGAGTCCTGGCCTTGGAAAGATACCTAAAGG
ATCAACAGCTCCTAGGGATGTGGGGCTGCTCTGGAAAACTCATCTGCACCACTAATGTATATTGGAACTCTAGTTGG
AGTAATAAAACTTATGGTGATATTTGGGATAACATGACCTGGATGCAGTGGGAGAGAGAAATTAGCAATTATACAGA
AATGATATATGAATTGCTTGAAGAATCACAAAACCAGCAGGAAAAGAATGAACAAGATTTACTAGCATTGGACAGAT
GGAACAGTCTGTGGAATTGGTTTAACATAACAAATTGGCTGTGGTATATAAAAATATTCATAATGATAGTAGGAGGC
TTGATAGGTTTAAGAATAATTTTTGCTGTGCTTTCTTTAGTAAATAGAGTTAGGCAGGGATACTCACCTCTGTCGTT
GCAGACCCTTATCCCAAGCCCGAGGGGACCAGACAGGCCCGGAGGAATCGAAGAAGAAGGTGGAGAGCAAGACAGAA
AGAGATCAACGCGATTAGTGAGCGGATTCTTAGCGCTTGCCTGGGACGACCTGCGGAGCCTGTGCCTTTTCATCTAC
CACCGATTGAGAGACTTCATATTAATTGCAGCGAGAGCGGGGGAACTTCTGGGACGCAGCAGTCTCAAGGGACTACG
GAGAGGATGGGAAGCCCTTAAGTATCTGGGAAGTCTTGTGCAGTATTGGGGCCGGGAACTAAAAAGGAGTGCTATTA
```

FIG. 17B cont'd

```
GTCTATTGGATACCCTAGCAATAGCAGTAGGTGAAGGAACAGATAGGATTCTAGAATTTGCATTAAGAATTTGTAGA
GCTATCCGCAACATGCCTACAAGAATAAGACAGGGCTTTGAAACAGCTTTGCTATAA
>793010505.W78.9
ATGAGAGTGATGGGGATACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTAGATCAGATGCATGAAGA
TGTAATTAGTTTATGGGATCAAAGCCTCAAGCCATGTGTAAAGTTGACCCCACTCTGTGTCACTCTAAACTGTACCG
ATGCTACTGCCAGCAATGCTACTGCCAGCAATGCTACTGCCAGCAATGCTACTGCCAGCAATAGCAGTATAATAATA
GAGGGAATGAAAAATTGCTCTTTCAATATAACCACAGAATTAAGAGATAAGAGAGAGAAAAAGAATGCACTTTTTTA
TAAACTTGATATAGTACAACTAGATGGCAACTCTAGTCAGTATAGATTAATAAATTGTAATACCTCAGTCATAACAC
AAGCCTGTCCAAAGGTCTCTTTTGACCCAATTCCTATACATTATTGTGCTCCAGCTGGTTATGCGATTCTAAAGTGT
AATAATAAGACATTCAATGGAACAGGACCGTGTAATAATGTCAGCACAGTACAATGTACACATGGAATTAAGCCAGT
GGTTTCAACTCAACTATTGTTAAATGGTAGCCTAGCAGAAGGAGAGATAATAATTAGATCTAAAAATATAACAGACA
ATGGCAAAACAATAATAGTACATCTCAATGAATCTGTAAAGATTGAGTGTACGAGACCCAGTAATAACACAAGAACA
AGTATAAGAATAGGACCAGGACAAGCATTTTATGCAACAGGACAAGTAATAGGAGACATAAGAGAAGCACATTGTAA
CATTAGTGAAAGTAAATGGAATGAAACTTTACAAAGGGTAAGTAAAAAATTAAAAGAATACTTCCCTCAGAAGAATA
TAACATTTCAACCATCCTCAGGAGGGGACCTAGAAATTACAACACATAGCTTTAATTGTGGAGGAGAATTTTTCTAT
TGCAATACATCAAGCCTGTTTAATAGGACATATATGGCTAATAGTACAGATATGGCTAATAGTACAGAAACTAACAG
AACCATCACAATCCGCTGCAGAATAAAACAAATTATAAACATGTGGCAGGAGGTGGGACGAGCAATGTATGCCCCTC
CCATTGCAGGAAACATAACATGTATATCAAATATCACAGGACTACTATTGACAAGGGATGGAGGAAAAACAATACG
GAGACATTCGAGACATTCAGACCTGGAGGAGAAATATGAAGGACAATTGGAGAAGTGAATTATATAAATATAAAGT
GGTAGAAGTTAAGCCATTAGGAGTAGCACCCACTAATGCAAGAAGGAGAGTGGTGGAGAGAGAAAAAAGAGCAGTGG
GAATGGGAGCTGTGTTCCTTGGGTTCTTGGGAGCGGCAGGAAGCACTATGGGCGCAGCATCAATAACGCTGACGGTA
CAGGCCAGACAATTATTGTCTGGTATAGTGCAACAGCAAAGCAATTTGCTGAAGGCTATAGAGGCTCAACAGCATAT
GTTGAAACTCACGGTCTGGGGCATTAAACAGCTCCAGGCAAGAGTCCTGGCCTTGGAAAGATACCTAAAGGATCAAC
AGCTCCTAGGGATGTGGGGCTGCTCTGGAAAACTCATCTGCACCACTAATGTATATTGGAACTCTAGTTGGAGTAAT
AAAACTTATGGTGATATTTGGGATAACATGACCTGGATGCAGTGGGAGAGAGAAAATTAGCAATTATACAGAAATGAT
ATATGAATTGCTTGAAGAATCACAAAACCAGCAGGAAAAGAATGAACAAGATTTACTAGCATTGGACAGATGGAACA
GTCTGTGGAATTGGTTTAACATAACAAAGTGGCTGTGGTATATAAAAATATTCATAATGATAGTAGGAGGCTTGATA
TGTTTAAGAATAATTTTTGCTGTGCTTTCTTTAGTAAATAGAGTTAGGCAGGGATACTCACCTCTGTCGTTGCAGAC
CCTTATCCCAAGCCCGAGGGGACCAGACAGGCCCGGAGGAATCGAAGAAGAAGGTGGAGAGCAAGACAGAAAGAGAT
CAACGCGATTAGTGAGCGGATTCTTAGCGCTTGTCTGGGACGACCTGCGGAGCCTGTGCCTTTTCATCTACCACCGA
TTGAGAGACTTCATATTAATTGCAGCGAGAGCGGGGAACTTCTGGGACGCAGCAGTCTCAAGGGACTACGGAGAGG
ATGGGAAGCCCTTAAGTATCTGGGAAGTCTTGTGCAGTATTGGGGCCTGGGAACTAAAAAGGAGTGCTATTAGTCTAT
TGGATACCCTAGCAATAGCAGTAGGTGAAGGAACAGATAGGATTCTAGAATTTGCATTAGGAATTTGTAGAGCTATC
CGCAACATACCTACAAGAATAAGACAGGGCTTTGAAACAGCTTTGCTATAA
>793010505.W78.26
ATGAGAGTGATGGGGAGACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTAGATCAGATGCATGAAGA
TGTAATTAGTTTATGGGATCAAAGCCTCACGCCATGTGTAAAGTTGACCCCCACTCTGTGTCACTCTAAACTGTACCG
ATGCTACTGCCAGCAATGCTACTGCCAGCAATGCTACTGCCAGCAATGCTACTGCCAGCAATAGCAGTATAATAATA
GAGGGAATGAAAAATTGCTCTTTCAATATAACCACAGAATTAAGAGATAAGAGAGAGAAAAAGAATGCACTTTTTTA
TAAACTTGATATAGTACAACTAGATGGCAACTCTAGTCAGTATAGATTAATAAATTGTAATACCTCAGTCATAACAC
AAGCCTGTCCGAAGGTCTCTTTTGACCCAATTCCTATACATTATTGTGCTCCAGCTGGTTATGCGATTCTAAAGTGT
AATAATAAGACATTCAATGGAACAGGACCGTGTAATAATGTCAGCACAGTACAATGTACACATGGAATTAAGCCAGT
GGTTTCAACTCAACTATTGTTAAATGGTAGCCTAGCAGAAGGAGAGATAATAATTAGATCTAAAAATATAACAGACA
ATGGCAAAACAATAATAGTACATCTCAATGAATCTGTAAAGATTGAGTGTACGAGACCCAGTAATAACACAAGAACA
AGTATAAGAATAGGACCAGGACAAGCATTTTATGCAACAGGACAAGTAATAGGAGACATAAGAGAAGCACATTGTAA
CATTAGTGAAAGTAAATGGAATGAAACTTTACAAAGGGTAAGTGAAAAATTAAAAGAATACTTCCCTAATAAGAATA
TAACATTTCAACCATCCTCAGGAGGGGACCTAGAAATTACAACACATAGCTTTAATTGTGGAGGAGAATTTTTCTAT
TGCAATACATCAAGCCTGTTTAATAGGACATATATGTTTAATAGTACAGATATGGCTAATAGTACAGAAACTAACAG
TACACGAATCATCACAATCCGCTGCAGAATAAAACAAATTATAAACATGTGGCAGGAGGTGGGACGAGCAATGTATG
CCCCTCCCATTGCAGGAAACATAACATGTATATCAAATATCACAGGACTACTATTGACAAGGGATGGAGGAAACAGC
AGTACCGAGACATTCAGACCTGAGGAGGAAATATGAAGGACAATTGAGAAGTGAATTATATAAATATAAAGTGGT
AGAAGTTAAGCCATTAGGAGTAGCACCCACTAATGCAAGAAGGAGAGTGGTGGAGAGAGAAAAAAGAGCAGTGGGAA
TGGGAGCTGTGTTCCTTGGGTTCTTGGGAGCGGCAGGAAGCACTATGGGCGCAGCATCAATAACGCTGACGGTACAG
GCCAGACAATTATTGTCTGGTATAGTGCAACAGCAAAGCAATTTGCTGAAGGCTATAGAGGCTCAACAGCATATGTT
GAAACTCACGGTCTGGGGCATTAAACAGCTCCAGGCAAGAGTCCTGGCCTTGGAAAGATACCTAAAGGATCAACAGC
TCCTAGGGATGTGGGGCTGCTCTGGAAAACTCATCTGCACCACTAATGTATATTGGAACTCTAGTTGGAGTAATAAA
ACTTATGGTGATATTTGGGATAACATGACCTGGATGCAGTGGGAGGGAGAAATTAGCAATTATACAGAAATAATATA
TAAATTGCTTGAAGAATCACAAAACCAGCAGGAAAAGAATGAACAAGATTTATTAGCATTGGACAGATGGAACAGTC
TGTGGAATTGGTTTAACATAACAAATTGGCTGTGGTATATAAAAATATTCATAATGATAGTAGGAGGCTTGATAGGT
TTAAGAATAATTTTTGCTGTGCTTTCTTTAGTAAATAGAGTTAGGCAGGGATACTCACCTCTGTCGTTGCAGACCCT
TATCCCAAGCCCGAGGGGACCAGACAGGCCCGGAGGAATCGAAGAAGAAGGTGGAGAGCAAGACAGAAAGAGATCAA
CGCGATTAGTGAGCGGATTCTTAGCGCTTGCCTGGGACGACCTGCGGAGCCTGTGCCTTTTCATCTACCACCGATTG
AGAGACTTCATATTAATTGCAGCGAGAGCAGGGGAACTTCTGGGACGCAGCAGTCTCAAGGGACTACGGAGAGGATG
GGAAGCCCTTAAGTATCTGGGAAGTCTTGTGCAGTATTGGGGCCGGGAACTAAAAAGGAGTGCTATTAGTCTATTGG
```

FIG. 17B cont'd

```
ATACCCTAGCAATAGCAGTAGGTGAAGGAACAGATAGGATTCTAGAATTTGCATTAGGAATTTGTAGAGCTATCCGC
AACATACCTACAAGAATAAGACAGGGCTTTGAAACAGCTTTGCTATAA
>703010505.W78.29
ATGAGAGTGATGGGGATACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTAGATCAGATGCATGAAGA
TGTAATTAGTTTATGGGATCAAAGCCTCAAGCCATGTGTAAAGTTGACCCCACTCTGTGTCACTCTAAACTGTGCCG
ATGCTACTACCAATGCTACTGCCAGCAATGCTACTGCCAGCAATGCTACTGCCAGCAATAGCAGTATAATAGAGGGA
ATGAAAAATTGCTCTTTCAATATAACCACAGAATTAAGAGATAAGAGAGGAAAAAAGAATGCACTTTTTTATAAACT
TGATATAGTACAACTAGATGGCAACTCTAGTCAGTATAGATTAATAAATTGTAATACCTCAGTCATAACACAAGCCT
GTCCAAAGGTCTCTTTTGACCCAATTCCTATACATTATTGTGCTCCAGCTGGTTATGCGATTCTAAAGTGTAATAAT
AAGACATTCAATGGAACAGGACCGTGTAATAATGTCAGCACAGTACAATGTACACATGGAATTAAGCCAGTGGTTTC
AACTCAACTATTGTTAAATGGTAGCCTAGCAGAAGGAGAGATAATAATTAGATCTGAAAACATAACAGACAATGGCA
AACAATAATAGTACATCTCAATGAATCTGTAAAGATTGAGTGTACGAGACCCAGTAATAACACAAGAACAAGTATA
AGAATAGGACCAGGGCAAGCATTTTATGCAACAGGACAAGTAATAGGAGACATAAGAGAAGCACATTGTAACATTAG
TGAAAGTAAATGGAATGAAACTTTACAAAGGGTAAGTAAAAAATTAAAAGAATACTTCCCTCTTAAGAATATAACAT
TCAACCATCCTCAGGAGGGGACCTAGAAATTACAACACATAGCTTTAATTGTGGAGGAGAATTTTTCTATTGCAAT
ACATCAAGCCTGTTTAATAGGACATATATGGCTAATAGTACAGATATGGCTAATAGTACAGAAACTAACAGTACACG
AATCATCACAATCCGCTGCAGAATAAAACAAATTATAAACATGTGGCAGGAGGTGGGACGAGCAATGTATGCCCCTC
CCATTGCAGGAAACATAACATGTATATCAAATATCCACAGGACTACTATTGACAAGGGATGGAGGAAACAATACGAAT
ACGGAGACATTCAGACCTGGAGGAGGAAATATGAAGGACAATTGGAGAAGTGAATTATATAAATATAAGGTGGTAGA
AGTTAAGCCATTAGGAGTAGCACCCACTAATGCAAGAAGGAGAGTGGTGGAGAGAGAAAAAGAGCAGTGGGAATGG
GAGCTGTGTTCCTTGGGTTCTTGGGAGCGGCAGGAAGCACTATGGGCGCAGCATCAATAACGCTGACGGTACAGGCC
AGACAATTATTGTCTGGTATAGTGCAACAGCAAAGCAATTTGCTGAAGGCTATAGAGGCTCAACAGCATATGTTGAA
ACTCACGGTCTGGGGCATTAAACAGCTCCAGGCAAGAGTCCTGGCCTTGGAAAGATACCTAAAGGATCAACAGCTCC
TAGGGATGTGGGGCTGCTCTGGAAAACTCATCTGCCACCACTAATGTATATTGGAACTCTAGTTGGAGTAATAAAACT
TATGGTGATATTTGGGATAACATGACCTGGATGCAGTGGGAGAGAGAAATTAGCAATTATACAGAACTAATATATGA
ATTGCTTGAAGAATCACAAAACCAGCAGGAAAAGAATGAACAAGATTTACTAGCATTGGACAGATGGAACAGTCTGT
GGAATTGGTTTAACATAACAAATTGGCTGTGGTATATAAAAATATTCATAATGATAGTAGGAGGCTTGATAGGTTTA
AGAATAATTTTTGCTGTGCTTTCTTTAGTAAATAGAGTTAGGCAGGGATACTCACCTCTGTCGTTGCAGACCCTTAT
CCCAAGCCCGAGGGGACCAGACAGGCCCGGAGGAATCGAAGAAGGTGGAGAGCAAGACAGAAACAGATCAACGC
GATTAGTGAGCGGATTCTTAGCGCTTGCCTGGGACGACCTGCGGAGCCTGTGCCTTTTCATCTACCACCGATTGAGA
GACTTCATATTAATTGCAGCGAGAGCGGGGGAACTTCTGGGACGCAGCAGTCTCAAGGGACTACGGAGAGGATGGGA
AGCCCTTAAGTATCTGGGAGGTCTTGTGCAGTATTGGGGCCTGGAACTAAAAAGGAGTGCTATTAGTCTATTGGATA
CCCTAGCAATAGCAGTAGGTGAAGGAACAGATAGGATTCTAGAATTTGTATTAGGAATTTGTAGAGCTATCCGCAAC
ATACCTACAAGAATAAGACAGGGCTTTGAAACAGCTTTGCTATAA
>703010505.W78.5
ATGAGAGTGATGGGGATACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGCGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTAATGCTACTGCCAGCAATACCAATGCTACTGCCAGCAATATCAATGCTACTGCCAGCAATAGCAGTATAATA
GAGGGAATGAAAAATTGCTCTTTCAGTATAACCACAGAATTAAGAGATAAGAGAGAGAAAAAGTATGCACTTTTTTA
TAAACTTGATATAGTACAACTAGATGGCAACTCTAGTCAGTATAGATTAATAAATTGTAATACCTCAGTCATAACAC
AAGCCTGTCCAAAGGTCTCTTTTGACCCAATTCCTATACATTATTGTGCTCCAGCTGGTTATGCGATTCTAAAGTGT
AATAATAAGACATTCAATGGAACAGGACCGTGTAATAATGTCAGCACAGTACAATGTACACATGGAATTAAGCCAGT
GGTTTCAACTCAACTATTGTTAAATGGTAGCCTAGCAGAAGGAGAGATAATAATTAGATCTGAAAACATAACAGACA
ATGGCAAAACAATAATAGTGCATCTCAATGAATCTGTAAAGATTGAGTGTACGAGACCCAGTAATAACACAAGAACA
AGTATAAGAATAGGACCAGGACAAGCATTTTATGCAACAGGACAAGTAATAGGAGACATAAGAGAAGCACATTGTAA
CATTAGTGAAAGTAAATGGAATGAAACTTTACAAAGGGTAAGTAAAAAATTAGAAGAATACTTCCCTCATAAGGATA
TAACATTTCAACCATCCTCAGGAGGGGACCTAGAAGTTACAACACATAGCTTTAATTGTGGAGGAGAATTTTTCTAT
TGCAATACATCAAGCCTGTTTAATAGGACATATATGGCTAATAGTACAGATATGGCTAATAGTACAGAAACTAACAG
TACACGAATCATCACAATCCGCTGCAGAATAAAACAAATTATAAACATGTGGCAGGAGGTGGGACGAGCAATGTATG
CCCCTCCCATTGCAGGAAACATAACATGTATATCAAATATCCACAGGACTACTATTGACAAGGGATGGAGGAAAAAC
AGGGATAGAGGAAAAAACAATACGGAGACATTCAGACCTGGAGGAGGAAATATGAAGGACAATTGGAGAAGTGAATT
ATATAAATATAAAGTGGTAGAAGTTAAGCCATTAGGAGTAGCACCCACTAATGCAAGAAGGAGAGTGGTGGAGAGAG
AAAAAGAGCAGTGGGAATGGGAGCTGTGTTCCTTGGGTTCTTGGGAGCGGCAGGAAGCACTATGGGCGCAGCATCA
ATAACGCTGACGGTACAGGCCAGACAATTATTGTCTGGTATAGTGCAACAGCAAAGCAATTTGCTGAAGGCTATAGA
GGCTCAACAGCATATGTTGAAACTCACGGTCTGGGGCATTAAACAGCTCCAGGCAAGAGTCCTGGCCTTGGAAAGAT
ACCTAAAGGATCAACAGCTCCTAGGGATGTGGGGCTGCTCTGGAAAACTCATCTGCACCACTAATGTATATTGGAAC
TCTAGTTGGAGTAATAAAACTTATGGTGATATTTGGGATAACATGACCTGGATGCAGTGGGAGAGAGAAATTAGCAA
TTATACAGAAAATAATATGACTTGCTTGAAGAATCACAAAACCAGCAGGAAAAGAATGAACAAGATTTACTAGCAT
TGGACAGATGGAACAGTCTGTGGAATTGGTTTAACATAACAAATTGGCTGTGGTATATAAAAATATTCATAATGATA
GTAGGAGGCTTGATAGGTTTAAGAATAATTTTTGCTGTGCTTTCTTTAGTAAATAGAGTTAGGCAGGGATACTCACC
TCTGTCGTTGCAGACCCTTATCCCAAGCCCGAGGGGACCAGACAGGCCCGGAGGAATCGAAGAAGGTGGAGAGC
AAGACAGAAACAGATCAACGCGATTAGTGAGCGGATTCTTAGCGCTTGCCTGGGACGACCTGCGGAGCCTGTGCCTT
TTCATCTACCACCGATTGAGAGACTTCATATTAATTGCAGCGAGAGCGGGGGAACTTCTGGGACGCAGCAGTCTCAA
GGGACTACGGAGAGGGTGGGAAGCCCTTAAGTATCTGGGAGGTCTTGTGCAGTATTGGGGCCTGGAACTAAAAAGGA
```

FIG. 17B cont'd

```
GTGCTATTAGTCTATTGGATACCCTAGCAATAGCAGTAGGTGAAGGAACAGATAGGATTCTAGAATTTGTATTAGGA
ATTTGTAGAGCTATCCGCAACATACCTACAAGAATAAGACAGGGCTTTGAAACAGCTTTGCTATAA
>703010505.W78.30
ATGAGAGTGATGGGGATACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGCGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTAATGCTACTGCCAGCAATACCAATGCTACTGCCAGCAATATCAATGCTACTGCCAGCGATAGCAGTATAATA
GAGGGAATGAAAAATTGCTCTTTCAATATAACCACAGAATTAAGAGATAAGAGAGAAAAAAGTATGCACTTTTTTA
TAAACTTGATATAGTACAACTAGATGGCAACTCTAGTCAGTATAGATTAATAAATTGTAATACCTCAGTCATAACAC
AAGCCTGTCCAAAGGTCTCTTTTGACCCAATTCCTATACATTATTGTGCTCCAGCTGGTTATGCGATTCTAAAGTGT
AATAATAAGACATTCAATGGAACAGGACCGTGTAATAATGTCAGCACAGTACAATGTACACATGGAATTAAGCCAGT
GGTTTCAACTCAACTATTGTTAAATGGTAGCCTAGCAGAAGGAGAGATAATAATTAGATCTGAAAATATAACAAACA
GTGCCAAAACAATAATAGTACATCTCAATGAATCTGTAAAGATTGAGTGTACGAGACCCAGTAATAACACAAGAACA
AGTATAAGAATAGGACCAGGACAAGCATTTTATGCAACAGGACAAGTAATAGGAGACATAAGAAAAGCACATTGTAA
CATTAGTGAAAGTAAATGGAATGAAACTTTACAAAGGGTAAGTAAAAAATTAAAAGAATACTTCCCTCATAAGAATA
TAACATTTCAACCATCCTCAGGAGGGACCTAGAAGTTACAACACATAGTTTTAATTGTGGAGGAGAATTTTTCTAT
TGCAATACATCAAGCCTGTTTAATAGGACATACATGGCTAATAGTACAGAAACTAACAGTACACGAACCATCACACT
CCACTGCAGAATAAAACAAATTATAAACATGTGGCAGGAGGTGGGACGAGCAATGTATGCCCCTCCCATTGCAGGAA
ACATAACATGTATATCAAATATCACAGGACTACTATTGACAAGGGATGGAGGAAATAACAATACGGAGACATTCAGA
CCTGGAGGAGGAAATATGAAGGACAATTGGAGAAGTGAATTATATAAATATAAAGTGGTAGAAGTTAAGCCATTAGG
AGTAGCACCCACTAATGCAAGAAGGAGAGTGGTGGAGAGAGAAAAAAGAGCAGTGGGAATGGGAGCTGTGTTCCTTG
GGTTCTTGGGAGCGGCAGGAAGCACTATGGGCGCAGCATCAATAACGCTGACGGTACAGGCCAGACAATTATTGTCT
GGTATAGTGCAACAGCAAAGCAATTTGCTGAAGGCTATAGAGGCTCAACAGCATATGTTGAAACTCACGGTCTGGGG
CATTAAACAGCTCCAGGCAAGAGTCCTGGCCTTGGAAAGATACCTAAAGGATCAACAGCTCCTAGGGATGTGGGGCT
GCTCTGGAAAACTCATCTGCACCACTAATGTATATTGGAACTCTAGTTGGAGTAATAAAACTTATGGTGATATTTGG
GATAACATGACCTGGATGCAGTGGGAGAGAGAAATTAGCAATTATACAGAAATAATATATGACTTGCTTGAAGAATC
ACAAAACCAGCAGGAAAAGAATCAAGATTTACTAGCCATTGGACAGATGGAACAGCTCTGTGGAATTGGTTTAACA
TAACAAAATGGCTGTGGTATATAAAAATATTCATAATGATAGTAGGAGGCTTGATAGGTTTAAGAATAATTTTTGCT
GTGCTTTCTTTAGTAAATAGAGTTAGGCAGGGATACTCACCTCTGTCGTTGCAGACCCTTATCCCAAGCCCGAGGGG
ACCAGACAGGCCCGGAGGAATCGAAGAAGAAGGTGGAGAGCAAGACAGAAACAGATCAACGCGATTAGTGAGCGGAT
TCTTAGCGCTTGCCTGGGACGACCTGCGGAGCCTGTGCCTTTCATCTACCACCGATTGAGAGACTTCATATTAATT
GCAGCGAGAGCGGGGGAACTTCTGGGACGCAGCAGTCTCAAGGGACTACGGAGGGGATGGGAAGCCCTTAAGTATCT
GGGAAGTCTTGTGCAGTATTGGGGCCTGGAACTAAAAAGGAGTGCTATTAGTCTATTGGATACCCTAGCAATAGCAG
TAGGTGAAGGAACAGATAGGATTCTAGAATTTGTATTAGGAATTTGTAGAGCTATCCGCAACATACCTACAAGAATA
AGACAGGGCTTTGAAACAGCTTTGCTATAA
>703010505.W78.33
ATGAGAGTGACGGGGATACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGCAGATCAGATGCATGAAGA
TGTAATTAGTTTATGGGATCAAAGCCTCAAGCCATGTGTAAAGTTGACCCCACTCTGTGTCACTCTAAACTGTATCG
ATGCCAATGCTACTGCCAGCAATGCTACTGCCAGCAATAGCAGTATAATAGAGGGAATGAAAAATTGCTCTTTCAAT
ATAACCACAGAATTAAGAGATAAGATAGAGAAAAGAATGCACTTTTTTATAAACTTGATATAGTACAACTAGATGG
CAACTCTAGTCAGTATAGATTAATAAATTGTAATACCTCAGTCATAACACAAGCCTGTCCAAAGGTCTCTTTTGACC
CAATTCCTATACATTATTGTGCTCCAGCTGGTTATGCGATTCTAAAGTGTAATAATGACATTCAATGGAACAGGA
CCGTGTAATAATGTCAGCACAGTACAATGTACACATGGAATTAAGCCAGTGGTTTCAACTCAACTATTGTTAAATGG
TAGCCTAGCAGAAGGAGAGATAATAATTAGATCTGAAAATATAACAAACAGTGCCAAAACAATAATAGTACATCTCA
ATGAATCTGTAAAGATTGAGTGTACGAGACCCAGTAATAACACAAGAACAAGTATAAGAATAGGACCAGGACAAGCA
TTTTATGCAACAGGACAAGTAATAGGAGACATAAGAAAAGCACATTGTAACATTAGTGAAAGTAAATGGAATGAAAC
TTTACAAAGGGTAAGTAAAAAATTAAAAGAATACTTCCCTCATAAGAATATAACATTTCAACCATCCTCAGGAGGGG
ACCTAGAAGTTACAACACATAGCTTTAATTGTGGAGGAGAATTTTTCTATTGCAATACATCAAGCCTGTTTAATAGG
ACATACATGGCTAATAGTACAGAAACTAACAGTACACGAACCATCACACTCCACTGCAGAATAAAACAAATTATAAA
CATGTGGCAGGAGGTGGGACGAGCAATGTATGCCCCTCCCATTGCAGGAAACATAACATGTATATCAAATATCACAG
GACTACTATTGACAAGGGATGGAGGAAATAACAATACTGGAGACATTCAGACCTGGAGGAGGAAATATGAAGGAC
AATTGGAGAAGTGAATTATATAAATATAAAGTGGTAGAAATTAAGCCATTAGGAGTAGCACCCACTAATGCAAGAAG
GAGAGTGGTGGAGAGAGAAAAAAGAGCAGTGGGAATGGGAGCTGTGTTCCTTGGGTTCTTGGGAGCGGCAGGAAGCA
CTATGGGCGCAGCATCAATAACGCTGACGGTACAGGCCAGACAATTATTGTCTGGTATAGTGCAACAGCAAAGCAAT
TTGCTGAAGGCTATAGAGGCTCAACAGCATATGTTGAAACTCACGGGTCTGGGGCATTAAACAGCTCCAGGCAAGAGT
CCTGGCCTTGGAAAGATACCTAAAGGATCAACAGCTCCTAGGGATGTGGGGCTGCTCTGGAAAACTCATCTGCACCA
CTAATGTATATTGGAACTCTAGTTGGAGTAATAAAACTTATGGTGATATTTGGGATAACATGACCTGGATGCAGTGG
GAGAGAGAAATTAGCGATTATACAGAAATAATATATGAATTGCTTGAAGAATCACAAAACCAGCAGGAAAAGAATGA
ACAAGATTTACTAGCATTGGACAGATGGAACAGTCTGTGGAATTGGTTTAACATAACAAACTGGCTGTGGTATATAA
AAATATTCATAATGATAGTAGGAGGCTTGATAGGTTTAAGAATAATTTTTGCTGTGCTTTCTTTAGTAAATAGAGTT
AGGCAGGGATACTCACCTCTGTCGTTGCAGACCCTTACCCCAAGCCCGAGGGGACCAGACAGGCCCGGAGGAATCGA
AGAAGAAGGTGGAGAGCAAGACAGAAACAGATCAACGCGATTAGTGAGCGGATTCTTAGCGCTTGCCTGGGACGACC
TGCGGAGCCTGTGCCTTTCATCTACCACCGATTGAGAGACTTCATATTAATTGCAGCGAGAGCGGGGGAACTTCTG
GGACGCAGCAGTCTCAAGGGACTACGGAGAGGATGGGAAGCCCTTAAGTATCTGGGAGGTCTTGTGCAGTATTGGGG
CCTGGAACTAAAAAGGAGTGCTATTAGTCTATTGGATACCCTAGCAATAGCAGTAGGTGAAGGAACAGATAGGATTC
```

FIG. 17B cont'd

```
TAGAATTTGTATTAGGAATTTGTAGAGCTATCCGCAACATACCTACAAGAATAAGACAGGGCTTTGAAACAGCTTTG
CTATAA
>703010505.W78.39
ATGAGAGTGATGGGGATACAGAGGAATTATACACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCTTGTGTACCCACAGACCCCAATCCA
CAAGAAATGGTTTTAAAAAATGTAACAGAAAATTTCAACATGTGGAAAAATGACATGGTAGATCAGATGCATGAAGA
TGTAATTAGTTTATGGGATCAAAGCCTCAAGCCATGTGTAAAATTGACCCCACTCTGTGTCACTCTAAACTGTGCCA
ATGCTACTAATGCTACTGCCAGCAATAGCAGTATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAACATAACAGACAATGGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAGACATAAGAGAAGCACATTGTAACATTAGTGAAAGTAAATGGAATGAAACTTTACAAAGGGT
AAGTGAAAAATTAAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
AATAGTACAGAAACTAACAGTACACGAATCATCACAATCCACTGCAGAATAAAACAAATTATAAACATGTGGCAGGA
GGTGGGACGAGCAATGTATGCCCCCCCCATTGCAGGAAACATAACATGTATATCAAATATCACAGGACTACTATTGA
CAAGGGATGGAGGAAACAATACGGAGACATTCGAGACATTCAGACCTGGAGGAGGAAATATGAAGGACAATTGGAGA
AGTGAATTATATAAATATAAAGTGGTAGAAGTTAAGCCATTAGGAGTAGCACCCACTAATGCAAGAAGGAGAGTGGT
GGAGAGAGAAAAAAGAGCAGTGGGAATGGGAGCTGTGTTCCTTGGGTTCTTGGGAGCGGCAGGAAGCACTATGGGCG
CAGCATCAATAACGCTGACGGTACAGGCCAGACAATTATTGTCTGGTATAGTGCAACAGCAAAGCAATTTGCTGAAG
GCTATAGAGGCTCAACAGCATATGTTGAAACTCACGGTCTGGGGCATTAAACAGCTCCAGGCAAGAGTCCTGGCCTT
GGAAAGATACCTAAAGGATCAACAGCTCCTAGGGATGTGGGGCTGCTCTGGAAAACTCATCTGCACCACTAATGTAT
ATTGGAACTCTAGTTGGAGTAATAAAACTTATGGTGATATTTGGGATAACATGACCTGGATGCAGTGGGAGAGAGAA
ATTAGCAATTATACAGAAATAATATATGAATTGCTTGAAGAATCACAAAACCAGCAGGAAAAGAATGAACAAGATTT
ACTAGCATTGGACAGATGGAACAGTCTGTGGAATTGGTTTAACATAACAAATTGGCTGTGGTATATAAAAATATTCA
TAATGATAGTAGGAGGCTTGATAGGTTTAAGAATAATTTTTGCTGTGCTTTCTTTAGTAAATAGAGTTAGGCAGGGA
TACTCACCTCTGTCGTTACAGACCCTTATCCCAAGCCCGAGGGGACCAGACAGGCCCGGAGGAATCGAAGAAGAAGG
TGGAGAGCAAGACAGAAACAGATCAACGCGATTAGTGAGCGGATTCTTAGCGCTTGCCTGGGACGACCTGCGGAGCC
TGTGCCTTTTCATCTACCACCGATTGAGAGACTTCATATTAATTGCAGCGAGAGCGGGGAACTTCTGGGACGCAGC
AGTCTCAAGGGACTACGGAGAGGGTGGGAAGCCCTTAAGTATCTGGGAAGTCTTGTGCAGTATTGGGGCCTGGAACT
AAAAAGGAGTGCTATTAGTCTATTGGATACCCTAGCAATAGCAGTAGGTGAAGGAACAGATAGGATTCTAGAATTTG
TATTAGGAATTTGTAGAGCTATCCGCAACATACCTACAAGAATAAGACAGGGCTTTGAAACAGCTTTGCTATAA
>703010505.W78.35
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCTCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCAATGCTACTGCCAGCA
ATGCTACTGCCAGCAATAGCAGTATATTAGAGGGAATGAAAAATTGCTCTTTCAATATAACCACAGAATTAAGAGAT
AAGAGAGAGAAAAAGAATGCACTTTTTTATAAACTTGATATAGTACAACTAGGTGGCAACTCTAGTCAGTATAGATT
AATAAATTGTAATACCTCAGTCATAACACAAGCCTGTCCAAAGGTCTCTTTTGACCCTATACATTATTGTG
CTCCAGCTGGTTATGCGATTCTAAAGTGTAATAATAAGACATTCAATGGAACAGGACCGTGTAATAATGTCAGCACA
GTACAATGTACACATGGAATTAAGCCAGTGGTTTCAACTCAACTATTGTTAAATGGTAGCCTAGCAGAAGGAGAGAT
AATAATTAGATCTAAAAATATAACAGACAATGGCAAAACAATAATAGTACATCTCAATGAATCTGTAAAGATTGAGT
GTACGAGACCCAGTAATAACACAAGAACAAGTATAAGAATAGGACCAGGACAAGCATTTTATGCAACAGGACAAGTA
ATAGGAGACATAAGAGAAGCACATTGTAACATTAGTGAAAGTAAATGGAATGAAACTTTACAAAGGGTAAGTGAAAA
ATTAAAAGAATACTTCCCTCAGAAGAATATAACATTTCAACCATCCTCAGGAGGGGACCTAGAAATTACAACACATA
GCTTTAATTGTGGAGGAGAATTTTTCTATTGCAATACATCAAGCCTGTTTAATAGAACATATATGGCTACTAGTACA
GATATGGCTAATAGTACAGAAACTAACAGTACACGAATCATCACAATCCGCTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAGAAAACAATACGGAGACATTCGAGACATTCAGACCTGGAGGAGGAAATATGAAG
GACAATTGGAGAAGTGAATTATATAAATATAAAGTGGTTAAGCCATTAGGAGTAGCACCCACTAATGCAAG
AAGGAGAGTGGTGGAGAGAGAAAAAAGAGCAGTGGGAATGGGAGCTGTGTTCCTTGGGTTCTTGGGAGCGGCAGGAA
GCACTATGGGCGCAGCATCAATAACGCTGACGGTACAGGCCAGACAATTATTGTCTGGTATAGTGCAACAGCAAAGC
AATTTGCTGAAGGCTAAAGAGGCTCAACAGCATATGTTGAAACTCACGGTCTGGGGCATTAAACAGCTCCAGGCAAG
AGTCCTGGCCTTGGAAAGATACCTAAAGGATCAACAGCTCCTAGGGATGTGGGGCTGCTCTGGAAAACTCATCTGCA
CCACTAATGTATATTGGAACTCTAGTTGGAGTAATAAAACTTATGGTGATATTTGGGATAACATGACCTGGATGCAG
TGGGAGAAGAAATTAACAATTATACAGAAACAATATATGCTTGAAGAATCACAAAACCAGCAGGAAAAGAATGAACA
TGAACAAGATTTACTAGCATTGGACAGATGGAACAGTCTGTGGAATTGGTTTAACATAACAAATTGGCTGTGGTATA
TAAAAATATTCATAATGATAGTAGGAGGCTTGATAGGTTTAAGAATAATTTTTGCTGTGCTTTCTTTAGTAAATAGA
GTTAGGCAGGGATACTCACCTCTGTCATTGCAGACCCTTATCCCAAGCCCGAGGGGACCAGACAGGCCCGGAGGAAT
CGAAGAAGAAGGTGGAGAGCAAGACAGAAACAGATCAACGCGATTAGTGAGCGGATTCTTAGCGCTTGCCTGGGACG
ACCTGCGGAGCCTGTGCCTTTTCATCTACCACCGATTGAGAGACTTCATATTAATTGCAGCGAGAGCGGGGAACTT
CTGGGACGCAGCAGTCTCAAGGGACTACGGAGAGGGTGGGAAGCCCTTAAGTATCTGGGAAGTCTTGTGCAGTATTG
GGGCCTGGAACTAAAAAGGAGTGCTATTAGTCTATTGGATACCCTAGCAATAGCAGTAGGTGAAGGAACAGATAGGA
```

FIG. 17B cont'd

```
TTCTAGAATTTGTATTAGGAATTTGTAGAGCTATCCGCAACATACCTACAAGAATAAGACAGGGCTTTGAAACAGCT
TTGCTATAA
>793010505.W78.3
ATGAGAGTGATGGGGATACAGAGGAACTATACACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTTAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGCCAGCAATAGCAGTATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATGGCAAAATAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAGACATAAGAGAAGCACATTGTAACATTAGTGAAAGTAAATGGAATGAAACTTTACAAAGGGT
AAGTAAAAAATTAAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAACAGGACATATATGGCT
ACTAGTACAGATATGGCTAATAGTACAGAAACTAACAGTACACGAATCATCACAATCCGCTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAGAAAACATACGGAGACATTCGAGACATTCAGACCTGGAGGAGGA
AATATGAAGGACAATTGGAGAAGTGAATTATATAAATATAAAGTAGTAGAAGTCAAGCCATTAGGAGTAGCACCCAC
TAATGCAAGAAGGAGAGTGGTGGAGAGAGAAAAAAGAGCAGTGGGAATGGGAGCTGTGTTCCTTGGGTTCTTGGGAG
CGGCAGGAAGCACTATGGGCGCAGCATCAATAACGCTGACGGTACAGGCCAGACAATTATTGTCTGGTATAGTGCAA
CAGCAAAGCAATTTGCTGAAGGCTATAGAGGCTCAACAGCATATGTTGAAACTCACGGTCTGGGGCATTAAACAGCT
CCAGGCAAGAGTCCTGGCCTTGGAAAGATACCTAAAGGATCAACAGCTCCTAGGGATGTGGGGCTGCTCTGGAAAAC
TCATCTGCACCACTAATGTATATTGGAACTCTAGTTGGAGTAATAAAACTTATGGTGATATTTGGGATAACATGACC
TGGATGCAGTGGGAGAGAGAAAATTAGCAATTATACAGAACTAATATATGAATTGCTTGAAGAATCACAAAACCAGCA
GGAAAAGAATGAACAAGATTTACTAGCATTGGACAGATGGAACAGTCTGTGGAATTGGTTTAACATAACAAATTGGC
TGTGGTATATAAAAATATTCATAATGATAGTAGGAGGCTTGATAGGTTTAAGAATAATTTTTGCTGTGCTTTCTTTA
GTAAATAGAGTTAGGCAGGGATACTCACCTCTGTCATTGCAGACCCTTATCCCAAGCCCGAGGGGACCAGACAGGCC
CGGAGGAATCGAAGAAGAAGGTGGAGAGCAAGACAGAAACAGATCAACGCGATTAGTGAGCGGATTCTTAGCGCTTG
CCTGGGACGACCTGCGGAGCCTGTGCCTTTTCATCTACCACCGATTGAGAGACTTCATATTAATTGCAGCGAGAGCG
GGGGAACTTCTGGGACGCAGCAGTCTCAAGGGACTACGGAGAGGGTGGGAAGCTCTTAAGTATCTGGGAAGTCTTGT
GCAGTATTGGGGCCTGGAACTAAAAGGAGTGCTATTAGTCTATTGGATACCCTAGCAATAGCAGTAGGTGAAGGAA
CAGATAGGATTCTAGAATTTGTATTAGGAATTTGTAGAGCTATCCGCAACATACCTACAAGAATAAGACAGGGCTTT
GAAACAGCTTTGCTATAA
>793010505.W78.23
ATGAGAGTGATGGGGATACAGAGGAATTATACACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTTAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGCCAGCAATAGCAGTATATTAGAGGGAATGAAAAATTGCTCTTTCAATATAACCATAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTGTGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATGGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAGACATAAGAGAAGCACATTGTAACATTAGTGAAAGTAAATGGAATGAAACTTTACAAAGGGT
AAGTAAAAAATTAAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAACAGGACATATATGGCT
ACTAGTACAGATATGGCTAATAGTACAGAAACTAACAGTACACGAATCATCACAATCCGCTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAGAAAACATACGGAGACATTCGAGACATTCAGACCTGGAGGAGGA
AATATGAAGGACAATTGGAGAAGTGAATTATATAAATATAAAGTGGTAGAAGTCAAGCCATTAGGAGTAGCACCCAC
TAATGCAAGAAGGAGAGTGGTGGAGAGAGAAAAAAGAGCAGTGGGAATGGGAGCTGTGTTCCTTGGGTTCTTGGGAG
CGGCAGGAAGCACTATGGGCGCAGCATCAATAACGCTGACGGTACAGGCCAGACAATTATTGTCTGGTATAGTGCAA
CAGCAAAGCAATTTGCTGAAGGCTATAGAGGCTCAACAGCATATGTTGAAACTCACGGTCTGGGGCATTAAACAGCT
CCAGGCAAGAGTCCTGGCCTTGGAAAGATACCTAAAGGATCAACAGCTCCTAGGGATGTGGGGCTGCTCTGGAAAAC
TCATCTGCACCACTAATGTATATTGGAACTCTAGTTGGAGTAATAAAACTTATGGTGATATTTGGGATAACATGACC
TGGATGCAGTGGGAGAGAGAAAATTAGCAATTATACAGAACTAATATATGAATTGCTTGAAGAATCACAAAACCAGCA
GGAAAAGAATGAACAAGATTTACTAGCATTGGACAGATGGAACAGTCTGTGGAATTGGTTTAACATAACAAATTGGC
TGTGGTATATAAAAATATTCATAATGATAGTAGGAGGCTTGATAGGTTTAAGAATAATTTTTGCTGTGCTTTCTTTA
GTAAATAGAGTTAGGCAGGGATACTCACCTCTGTCATTGCAGACCCTTATCCCAAGCCCGAGGGGACCAGACAGGCC
CGGACGACCTGCGGAGCCTGTGCCTTTTCATCTACCACCGATTGAGAGACTTCATATTAATTGCAGCGAGAGCG
GGGGAACTTCTGGGACGCAGCAGTCTCAAGGGACTACGGAGAGGGTGGGAAGCTCTTAAGTATCTGGGAAGTCTTGT
GCAGTATTGGGGCCTGGAACTAAAAGGAGTGCTATTAGTCTATTGGATACCCTAGCAATAGCAGTAGGTGAAGGAA
```

FIG. 17B cont'd

```
CAGATAGGATTCTAGAATTTGTATTAGGAATTTGTAGAGCTATCCGCAACATACCTACAAGAATAAGACAGGGCTTT
GAAACAGCTTTGCTATAA
>7030106S05.W78.17
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTTAACATGTGGAAAAATGACATGGTGGATCAGATGCATGAAGA
TGTAATTAGTTTATGGGATCAAAGCCTCAAGCCATGTGTAAAGTTAACCCCACTCTGTGTCACTCTAGACTGTATCA
ATGCTACTAATGCTACTGCCAGCAATAGCAGTATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACTCATGGAATTAAGCCAGTGGTTTCAACTCAACTATTGTTAAATGGTAGCCTAGCAGA
AGGAGAGATAATAATTAGATCTAAAAATATAACAGACAATGGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAGACATAAGAGAAGCACATTGTAACATTAGTGAAAGTAAATGGAATGAAACTTTACAAAGGGT
AAGTAAAAAATTAAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGTT
AATAGTACAGATATGGCTAATAGTACAGAAACTAACAGTACACGAACCATCACAATCCGCTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAGAAAACAATACGGAGACATTCGAGACATTCAGACCTGGAGGAGGA
AATATGAAGGACAATTGGAGAAGTGAATTATATAAATATAAAGTGGTAGAAGTTAAGCCATTAGGAGTAGCACCCAC
TAATGCAAGAAGGAGAGTGGTGGAGAGAGAAAAAGAGCAGTGGGAATGGGAGCTGTGTTCCTTGGGTTCTTGGGAG
CGGCAGGAAGCACTATGGGCGCAGCATCAATAACGCTGACGGTACAGGCCAGACAATTATTGTCTGGTATAGTGCAA
CAGCAAAGCAATTTGCTGAAGGCTATAGAGGCTCAACAGCATATGTTGAAACTCACGGTCTGGGGCATTAAACAGCT
CCAGGCAAGAGTCCTGGCCTTGGAAAGATACCTAAAGGATCAACAGCTCCTAGGGATGTGGGGCTGCTCTGGAAAAC
TCATCTGCACCACTAATGTATATTGGAACTCTAGTTGGAGTAATAAAACTTATGGTGATATTTGGGATAACATGACC
TGGATGCAGTGGGAGAGAGAAATTAGCAATTATACAGAACTAATATATGAATTGCTTGAAGAATCACAAAACCAGCA
GGAAAAGAATGAACAAGATTTACTAGCATTGGACAGATGGAACAGTCTGTGGAATTGGTTTAACATAACAAATTGGC
TGTGGTATATAAAAATATTCATAATGATAGTAGGAGGCTTGATAGGTTTAAGAATAATTTTTGCTGTGCTTTCTTTA
GTAAATAGAGTTAGGCAGGGATACTCACCTCTGTCATTGCAGACCCTTATCCCAAGCCCGAGGGGACCAGACAGGCC
CGGAGGAATCGAAGAAGAAGGTGGAGAGCAAGACAGAAACAGATCAACGCGATTAGTGAGCGGATTCTTAGCGCTTG
CCTGGGACGACCTGCGGAGCCTGTGCCTTTTCATCTACCACCGATTGAGAGACTTCATATTAATTGCAGCGAGAGCG
GGGGAACTTCTGGGACGCAGCAGTCTCAAGGGACTACGGAGAGGGTGGGAAGCCCTTAAGTATCTGGGAAGTCTTGT
GCAGTATTGGGGCCTGGAACTAAAAAGGAGTGCTATTAGTCTATTGGATACCCTAGCAATAGCAGTAGGTGAAGGAA
CAGATAGGATTCTAGAATTTGTATTAGGAATTTGTAGAGCTATCCGCAACATACCTACAAGAATAAGACAGGGCTTT
GAAACAGCTTTGCTATAA
>7030106S05.W78.31
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAGGTTGACCCCACTCTGTGTCACTCTAAACTGTATCA
ATGCTACTAATGCTACTGCCAGCAATAGCAGTATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGATGGCAACTCTAGTCA
GTATAGATTAATAAATTGTAATACCTCAGTCATAACATAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACTCATGGAATTAAGCCAGTGGTTTCAACTCAACTATTGTTAAATGGTAGCCTAGCAGA
AGGAGAGATAATAATTAGATCTAAAAATATAACAGACAATGGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAGACATAAGAGAAGCACATTGTAACATTAGTGAAAGTAAATGGAATGAAACTTTACAAAGGGT
AAGTAAAAAATTAAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
ACTAGTACAGATATGGCTAATAGTACAGAAACTAACAGTACACGAATCATCACAATCCGCTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAGAAAACAATACAGAGACATTCGAGACATTCAGACCTGGAGGAGGA
AATATGAAGGACAATTGGAGAAGTGAATTATATAAATATAAAGTGGTAGAAGTTAAGCCATTAGGAGTAGCACCCAC
TAATGCAAGAAGGAGAGTGGTGGAGAGAGAAAAAGAGCAGTGGGAATGGGAGCTGTGTTCCTTGGGTTCTTGGGAG
CGGCAGGAAGCACTATGGGCGCAGCATCAATAACGCTGACGGTACAGGCCAGACAATTATTGTCTGGTATAGTGCAA
CAGCAAAGCAATTTGCTGAAGGCTATAGAGGCTCAACAGCATATGTTGAAACTCACGGTCTGGGGCATTAAACAGCT
CCAGGCAAGAGTCCTGGCCTTGGAAAGATACCTAAAGGATCAACAGCTCCTAGGGATGTGGGGCTGCTCTGGAAAAC
TCATCTGCACCACTAATGTATATTGGAACTCTAGTTGGAGTAATAAAACTTATGGTGATATTTGGGATAACATGACC
TGGATGCAGTGGGAGAAAGAAATTAGCAATTATACAGAACTAATATATGAATTGCTTGAAGAATCACAAAACCAGCA
GGAAAAGAATGAACAAGATTTACTAGCATTGGACAGATGGAACAGTCTGTGGAATTGGTTTAACATAACAAATTGGC
TGTGGTATATAAAAATATTCATAATGATAGTAGGAGGCTTGATAGGTTTAAGAATAATTTTTGCTGCGCTTTCTTTA
GTAAATAGAGTTAGGCAGGGATACTCACCTCTGTCGTTACAGACCCTTATCCCAAGCCCGAGGGGACCAGACAGGCC
CGGAGGAATCGAAGAAGAAGGTGGAGAGCAAGACAGAAACAGATCAACGCGATTAGTGAGCGGATTCTTAGCGCTTG
CCTGGGACGACCTGCGGAGCCTGTGCCTTTTCATCTACCACCGATTGAGAGACTTCATATTAATTGCAGCGAGAGCG
GGGGAACTTCTGGGACGCAGCAGTCTCAAGGGACTACGGAGAGGGTGGGAAGCCCTTAAGTATCTGGGAAGTCTTGT
GCAGTATTGGGGCCTGGAACTAAAAAGGAGTGCTATTAGTCTATTGGATACCCTAGCAATAGCAGTAGGTGAAGGAA
```

FIG. 17B cont'd

CAGATAGGATTCTAGAATTTGTATTAGGAATTTGTAGAGCTATCCGCAACATACCTACAAGAATAAGACAGGGCTTT
GAAACAGCTTTGCTATAA
>703010505.W78.22
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAGGTTGACCCCACTCTGTGTCACTCTAAACTGTATCA
ATGCTACTAATGCTACTGCCAGCAATAGCAGTATATTAGAGGGAATGAAAAATTGCTCTTTCAATATAACCACAGAA
TTAAGAGATAAGAGAGAGAAAAAGAATGCACTTTTTTTATAAACTTGATATAGTACAACTAGATGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATGGCAAAACAATAATAGTACATCTCAATGAATCTGTAA
AGATTGAGTGTACGAGACCCAGTAATAACACAAGAACAAGTATAAGAATAGGACCAGGACAAGCATTTTACGCAACA
GGACAAGTAATAGGAGACATAAGAGAAGCACATTGTAACATTAGTGAAAGTAAATGGAATGAAACTTTACAAAGGGT
AAGTAAAAAATTAAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
ACTAGTACAGATATGGCTAATAGTACAGAAACTAACAGTACACGAATCATCACAATCCGCTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAGAAAACAATACGGAGACATTCGAGACATTCAGACCTGGAGGAGGA
AATATGAAGGACAATTGGAGAAGTGAATTATATAAATATAAAGTGGTAGAAGTTAAGCCATTAGGAGTAGCACCCAC
TAATGCAAGAAGGAGAGTGGTGGAGAGAGAAAAAAGAGCAGTGGGAATGGGAGCTGTGTTCCTTGGGTTCTTGGGAG
CGGCAGGAAGCACTATGGGCGCAGCATCAATAACGCTGACGGTACAGGCCAGACAATTATTGTCTGGTATAGTGCAA
CAGCAAAGCAATTTGCTGAAGGCTATAGAGGCTCAACAGCATATGTTGAAACTCACGGTCTGGGCATTAAACAGCT
CCAGGCAAGAGTCCTGGCCTTGGAAAGATACCTAAAGGATCAACAGCTCCTAGGGATGTGGGGCTGCTCTGGAAAAC
TCATCTGCACCACTAATGTATATTGGAACTCTAGTTGGAGTAATAAAACTTATGGTGATATTTGGGATAACATGACC
TGGATGCAGTGGGAGAGAGAAATTAGCAATTATACAGAACTAATATATGAATTGCTTGAAGAATCACAAAACCAGCA
GGAAAAGAATGAACAAGATTTACTAGCATTGGACAGATGGAACAGTCTGTGGAATTGGTTTAACATAACAAATTGGC
TGTGGTATATAAAAATATTCATAATGATAGTAGGAGGCTTGATAGGTTTAAGAATAATTTTTGCTGTGCTTTCTTTA
GTAAATAGAGTTAGGCAGGGATACTCACCTCTGTCATTGCAGACCCTTATCCCAAGCCCGAGGGGACCAGACAGGCC
CGGAGGAATCGAAGAAGAAGGTGGAGAGCAAGACAGAAACAGATCAACGCGATTAGTGAGCGGATTCTTAGCGCTTG
CCTGGGACGACCTGCGGAGCCTGTGCCTTTTCATCTACCACCGATTGAGAGACTTCATATTAATTGCAGCGAGAGCG
GGGGAACTTCTGGGACGCAGCAGTCTCAAGGGACTACGGAGAGGGTGGGAAGCCCTTAAGTATCTGGGAAGTCTTGT
GCAGTATTGGGGCCTGGAACTAAAAAGGAGTGCTATTAGTCTATTGGATACCCTAGCAATAGCAGTAGGTGAAGGAA
CAGATAGGATTCTAGAATTTGTATTAGGAATTTGTAGAGCTATCCGCAACATACCTACAAGAATAAGACAGGGCTTT
GAAACAGCTTTGCTATAA
>703010505.W78.1
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAGGTTGACCCCACTCTGTGTCACTCTAAACTGTATCA
ATGCTACTAATGCTACTGCCAGCAATAACAGTATATTAGAGGGAATGAAAAATTGCTCTTTCAATATAGCCACAGAA
TTAAGAGATAAGAGAGAGAAAAAGAATGCACTTTTTTATAAACTTGATATAGTACAACTAGATGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATGGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAAACTTTACAAAGGGT
AAGTAAAAAATTAAAAGAATACTTCCCTGATAAGAATATAACATTTCAACCATCCTCAGGAGGGGACCTAGAAATTA
CAACACATAGCTTTGTGTGGAGGAGAATTTTTCTATTGCAATACATCAAGCCTGTTTAATAGGACATATATGGCT
ACTAATACAGATATGGCTAATAGTACAGAAACTAACAGTACACGAATCATCACAATCCGCTGCAGAATAAGACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAGAAAACAATACGGAGACATTCGAGACATTCAGACCTGGAGGAGGA
AATATGAAGGACAATTGGAGAAGTGAATTATATAAATATAAAGTGGTAGAAGTTAAGCCATTAGGAGTAGCACCCAC
TAATGCAAGAAGGAGAGTGGTGGAGAGAGAAAAAAGAGCAGTGGGAATGGGAGCTGTGTTCCTTGGGTTCTTGGGAG
CGGCAGGAAGCACTATGGGCGCAGCATCAATAACGCTGACGGTACAGGCCAGACAATTATTGTCTGGTATAGTGCAA
CAGCAAAGCAATTTGCTGAAGGCTATAGAGGCTCAACAGCATATGTTGAAACTCACGGTCTGGGCATTAAACAGCT
CCAGGCAAGAGTCCTGGCCTTGGAAAGATACCTAAAGGATCAACAGCTCCTAGGGATGTGGGGCTGCTCTGGAAAAC
TCATCTGCACCACTAATGTATATTGGAACTCTAGTTGGAGTAATAAAACTTATGGTGATATTTGGGATAACATGACC
TGGATGCAGTGGGAGAGAGAAATTAGCAATTATACAGAACTAATATATGAATTGCTTGAAGAATCACAAAACCAGCA
GGAAAAGAATGAACAAGATTTACTAGCATTGGACAGATGGAACAGTCTGTGGAATTGGTTTAACATAACAAATTGGC
TGTGGTATATAAAAATATTCATAATGATAGTAGGAGGCTTGATAGGTTTAAGAATAATTTTTGCTGTGCTTTCTTTA
GTAAATAGAGTTAGGCAGGGATACTCACCTCTGTCATTGCAGACCCTTATCCCAAGCCCGAGGGGACCAGACAGGCC
CGGAGGAATCGAAGAAGAAGGTGGAGAGCAAGACAGAAACAGATCAACGCGATTAGTGAGCGGATTCTTAGCGCTTG
CCTGGGACGACCTGCGGAGCCTGTGCCTTTTCATCTACCACCGATTGAGAGACTTCATATTAATTGCAGCGAGAGCG
GGGGAACTTCTGGGACGCAGCAGTCTCAAGGGACTACGGAGAGGGTGGGAAGCCCTTAAGTATCTGGGAAGTCTTGT
GCAGTATTGGGGCCTGGAACTAAAAAGGAGTGCTATTAGTCTATTGGATACCCTAGCAATAGCAGTAGGTGAAGGAA

FIG. 17B cont'd

CAGATAGGATTCTAGAATTTGTATTAGGAATTTGTAGAGCTATCCGCAACATACCTACAAGAATAAGACAGGGCTTT
GAAACAGCTTTGCTATAA
>703010505.W78.15
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAGCTGTACCA
ATGCTACTAATGCTACTGCCAGCAATAGCAGTATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGATGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATGGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAGACATAAGAGAAGCACATTGTAACATTAGTGAAAGTAAATGGAATGAAACTTTACAAAGGGT
AAGTGAAAAATTAAAAGAATACTTCCCTCATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
ACTAGTACAGATATGGCTAATAGTACAGAAACTAACAGTACACGAATCATCACAATCCGCTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAAAAACGATACGGATACATTCAGACCTGAAGGAGGAAATATGAAG
GACAATTGGAGAAGTGAATTATATAAATATAAAGTGGTAGAAGTTAAGCCATTAGGAGTAGCACCCACTAATGCAAG
AAGGAGAGTGGTGGAGAGAGAAAAAAGAGCAGTGGGAATGGGAGCTGTGTTCCTTGGGTTCTTGGGAGCGGCAGGAA
GCACTATGGGCGCAGCATCAATAACGCTGACGGTACAGGCCAGACAATTATTGTCTGGTATAGTGCAACAGCAAAGC
AATTTGCTGAAGGCTATAGAGGCTCAACAGCATATGTTGAAACTCACGGTCTGGGGCATTAAACAGCTCCAGGCAAG
AGTCCTGGCCTTGGAAAGATACCTAAAGGATCAACAGCTCCTAGGGATGTGGGGCTGCTCTGGAAAACTCATCTGCA
CCACTAATGTATATTGGAACTCTAGTTGGAGTAATAAAACTTATGGTGATATTTGGGATAACATGACCTGGATGCAG
TGGGAGAGAGAAATTAGCAATTATACAGAACTAATATATGAATTGCTTGAAGAATCACAAAACCAGCAGGAAAAGAA
TGAACAAGATTTACTAGCATTGGACAGATGGAACAGTCTGTGGAATTGGTTTAACATAACAAATTGGCTGTGGTATA
TAAAAATATTCATAATGATAGTAGGAGGCTTGATAGGTTTAAGAATAATTTTTGCTGTGCTTTCTTTAGTAAATAGA
GTTAGGCAGGGATACTCACCTCTGTCATTGCAGACCCTTATCCCAAGCCCGAGGGGACCAGACAGGCCCGGAGGAAT
CGAAGAAGAAGGTGGAGAGCAAGACAGAAACAGATCAACGCGATTAGTGAGCGGATTCTTAGCGCTTGCCTGGGACG
ACCTGCGGAGCCTGTGCCTTTTCATCTACCACCGATTGAGAGACTTCATATTAATTGCAGCGAGAGCGGGGAACTT
CTGGGACGCAGCAGTCTCAAGGGACTACGGAGAGGGTGGGAAGCCCTTAAGTATCTGGGAAATCTTGTGCAGTATTG
GGGCCTGGAACTAAAAAGGAGTGCTATTAGTCTATTGGATACCCTAGCAATAGCAGTAGGTGAAGGAACAGATAGGA
TTCTAGAATTTGTATTAGGAATTTGTAGAGCTATCCGCAACATACCTACAAGAATAAGACAGGGCTTTGAAACAGCT
TTGCTATAA
>703010505.W78.27
ATGAGAGTGAGGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAGCTGTACCA
ATGCTACTAATGCTACTGCCAGCAATAGCAGTATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGATGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAACATAACAGACAATGGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAGACATAAGAGAAGCACATTGTAACATTAGTGAAAGTAAATGAATGAAACTTTACAAAGGGT
AAGTGAAAAATTAAAAGAATACTTCCCTCATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
ACTAGTACAGATATGGCTAATAGTACAGAAACTAACAGTACACGAATCATCACAATCCGCTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAAAAACGATACGGATACGGAGACATTCAGACCTGAAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGTTGGAGTAATAAAACTTATGGTGATATTTGGGATAACATGACCTGG
ATGCAGTGGGAGAGAGAAATTAGCAATTATACAGAACTAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
AACTTCTGGGACGCAGCAGTCTCAAGGGACTACGGAGAGGGTGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAAGGAACAG

FIG. 17B cont'd

```
ATAGGATTCTAGAATTTGTATTAGGAATTTGTAGAGCTATCCGCAACATACCTACAAGAATAAGACAGGGCTTTGAA
ACAGCTTTGCTATAA
>793010505.W78.18
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGAGCAAAGCCTCAAGCCATGTGTAAAGTTGACCCCACTCTGTGTCACTCTAAACTGTATCA
ATGCTACTAATGCTACTGCCAGCAATAGCAGTATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGATGGCAACTCTAGTCA
GTATAGATTAATAAATTGTAATACCTCAGCCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAACATAACAGACAATGGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAGACATAAGAGAAGCACATTGTAACATTAGTGAAAGTAAATGGAATGAAACTTTACAAAGGGT
AAGTGAAAAATTAAAAGAATACTTCCCTCATAAGAATATAACATTTCAACCATCCTCAGGAGGGGACCTAGAAGTTA
CAACACATAGCTTTAATTGTGGAGGAGAATTTTTCTATTGCAATACATCAAGCCTGTTTAATAGGACATATATGGCT
ACTAGTACAGATATGGCTAATAGTACAGAAACTAACAGTACACGAATCATCACAATCCGCTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAAAAACGATACGGATACGGAGACCATTCAGACCTGAAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGTTGGAGTAATAAAACTTATGGTGATATTTGGGATAACATGACCTGG
ATGCAGTGGGAGAGAGAAATTAGCAATTATACAGACATAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTTCAGACCCTTATCCCAAGCCCGAGGGGACCAGACAGGCCCGG
AGGAATCGAAGAAGAAGGTGGAGAGCAAGACAAGAAACAGAAACAGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTGCA
GTATTGGGGCCTGGAAACTAAAAAGGAGTGCTATTAGTCTATTGGATACCCTAGCAATAGCAGTAGGTGAAGGAACAG
ATAGGATTCTAGAATTTGTATTAGGAATTTGTAGAGCTATCCGCAACATACCTACAAGAATAAGACAGGGCTTTGAA
ACAGCTTTGCTATAA
>793010505.W78.20
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGAGCAAAGCCTCAAGCCATGTGTAAAGTTGACCCCACTCTGTGTCACTCTAAACTGTATCG
ATGCTACTGCCAGCAATGCTACTGCCATCAATATCAGTATAATAGAGGAAATGAAAAATTGCTCTTTCAATATAACC
ACAGAATTAAGAGATAAGAGAGAGAAAAAGAATGCACTTTTTTATAAACTTGATATAGTACAACTAGATGGCAACTC
TAGTCAGCATAGATTAATAAATTGTAATACCCTCAGTCATAACACAAGCCTGTCCAAAGGTCTCTTTTGACCCAATTC
CTATACATTATTGTGCTCCAGCTGGTTATGCGATTCTAAAGTGTAATAATAAGACATTCAATGGAACAGGACCGTGT
AATAATGTCAGCACAGTACAATGTACACATGGAATTAAGCCAGTGGTTTCAACTCAACTATTGTTAAATGGTAGCCT
AGCAGAAGGAGAGATAATAATTAGATCTAAAAATAACAGACAATGGCAAAATAATAATAGTACATCTCAATGAAT
CTGTAAAGATTGAGTGTACGAGACCCAGTAATAACACAAGAACAAGTATAAGAATAGGACCAGGACAAGCATTTTAT
GCAACAGGACAAGTAATAGGAAATATAAGAGAAGCACATTGTAACATTAGTGAAAGTAAATGGAATGAAACTTTACA
AAGGGTAAGTGAAAAATTAAAAGAATACTTCCCTCATAAGAATATAACATTTCAACCATCCTCAGGAGGGGACCTAG
AAATTACAACACATAGCTTTAATTGTGGAGGAGAATTTTTCTATTGCAATACATCAAGCCTGTTTAATAGGACATAT
ATGGCTACTAGTACAGATATGGCTAATAGTACAGAAACTAACAGTACACGAATCATCACAATCCGCTGCAGAATAAA
ACAAATTATAAACATGTGGCAGGAGGTGGGACGAGCAATGTATGCCCCTCCCATTGCAGGAAACATAACATGTATAT
CAAATATCACAGGACTACTATTGACAAGGGATGGAGGAAAAAACGATACGGATACGGAGACATTCAGACCTGAAGGA
GGAAATATGAAGGACAATTGGAGAAGTGAATTATATAAATATAAAGTGGTAGAAGTTAAGCCATTAGGAGTAGCACC
CACTAATGCAAGAAGGAGAGTGGTGGAGAGAGAAAAAAGAGCAGTGGGAATGGGAGCTGTGTTCCTTGGGTTCTTGG
GAGCGGCAGGAAGCACTATGGGCGCAGCATCAATAACGCTGACGGTACAGGCCAGACAATTATTGTCTGGTATAGTG
CAACAGCAAAGCAATTTGCTGAAGGCTATAGAGGCTCAACAGCATATGTTGAAACTCACGGTCTGGGGCATTAAACA
GCTCCAGGCAAGAGTCCTGGCCTTGGAAAGATACCTAAAGGATCAACAGCTCCTAGGGATGTGGGGCTGCTCTGGAA
AACTCATCTGCACCACTAATGTATATTGGAACTCTAGTTGGAGTAATAAAACTTATGGTGATATTTGGGATAACATG
ACCTGGATGCAGTGGGAGAGAGAAATTAGCAATTATACAGACATAATATATGAATTGCTTGAAGAATCACAAAACCA
GCAGGAAAAGAATGAACAAGATTTACTAGCATTGGACAGATGGAACAGTCTGTGGAATTGGTTTAACATAACAAATT
GGCTGTGGTATATAAAAATATTCATAATGATAGTAGGAGGCTTGATAGGTTTAAGAATAATTTTTGCTGTGCTTTCT
TTAGTAAATAGAGTTAGGCAGGGATACTCACCTCTGTCATTTCAGACCCTTATCCCAAGCCCGAGGGGACCAGACAG
GCCCGGAGGAATCGAAGAAGAAGGTGGAGAGCAAGACAGAAACAGATCAACGCGATTAGTGAGCGGATTCTTAGCGC
TTGTCTGGGACGACCTGCGGAGCCTGTGCCTTTTCATCTACCACCGATTGAGAGACTTCATATTAATTGCAGCGAGA
GCGGGGGAACTTCTGGGACGCAGCAGTCTCAAGGGACTACGGAGAGGGTGGGAAGCCCTTAAGTATCTGGGAAGTCT
TGTGCAGTATTGGGGCCTGGAACTAAAAAGGAGTGCTATTAGTCTATTGGATACCCTAGCAATAGCAGTAGGTGAAG
```

FIG. 17B cont'd

GAACAGATAGGATTCTAGAATTTGTATTAGGAATTTGTAGAGCTATCCGCAACATACCTACAAGAATAAGACAGGGC
TTTGAAACAGCTTTGCTATAA
>703010505.W78.10
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCG
ATGCTACTGCCAGCAATGCTACTGCCATCAATATCAGTATAATAGAGGAAATGAAAAATTGCTCTTTCAATATAACC
ACAGAATTAAGAGATAAGAGAGAGAAAAAGAATGCACTTTTTTATAAACTTGATATAGTACAACTAGATGGCAACTC
TAGTCAGCATAGATTAATAAATTGTAATACCTCAGTCATAACACAAGCCTGTCCAAAGGTCTCTTTTGACCCAATTC
CTATACATTATTGTGCTCCAGCTGGTTATGCGATTCTAAAGTGTAATAATAAGACATTCAATGGAACAGGACCGTGT
AATAATGTCAGCACAGTACAATGTACACATGGAATTAAGCCAGTGGTTTCAACTCAACTATTGTAAATGGTAGCCT
AGCAGAAGGAGAGATAATAATTAGATCTAAAAATATAACAGACAATGGCAAAACAATAATAGTACATCTCAATGAAT
CTGTAAAGATTGAGTGTACGAGACCCAGTAATAACACAAGAACAAGTATAAGAATAGGACCAGGACAAGCATTTTAT
GCAACAGGACAAGTAATAGGAAATATAAGAGAAGCACATTGTAACATTAGTGAAAGTAAATGGAATGAAACTTTACA
AAGGGTAAGTGAAAAATTAAAAGAATACTTCCCTCATAAGAATATAACATTTCAACCATCCTCAGGAGGGGACCTAG
AAATTACAACACATAGCTTTAATTGTGGAGGAGAATTTTTCTATTGCAATACATCAAGCCTGTTTAATAGGACATAT
ATGGCTACTAGTACAGATATGGCTAATAGTACAGAAACTAACAGTACACGAATCATCACAATCCGCTGCAGAATAAA
ACAAATTATAAACATGTGGCAGGAGGTGGGACGAGCAATGTATGCCCCTCCCATTGCAGGAAACATAACATGTATAT
CAAATATCACAGGACTACTATTGACAAGGGATGGAGGAAAAAACGATACGGATACGGAGACATTCAGACCTGAAGGA
GGAAATATGAAGGACAATTGGAGAAGTGAATTATATAAATATAAAGTGGTAGAAGTTAAGCCATTAGGAGTAGCACC
CACTAATGCAAGAAGGAGAGTGGTGGAGAGAGAAAAAAGAGCAGTGGGAATGGGAGCTGTGTTCCTTGGGTTCTTGG
GAGCGGCAGGAAGCACTATGGGCGCAGCATCAATAACGCTGACGGTACAGGCCAGACAATTATTGTCTGGTATAGTG
CAACAGCAAAGCAATTTGCTGAAGGCTATAGAGGCTCAACAGCATATGTTGAAACTCACGGTCTGGGGCATTAAACA
GCTCCAGGCAAGAGTCCTGGCCTTGGAAAGATACCTAAAGGATCAACAGCTCCTAGGGATGTGGGGCTGCTCTGGAA
AACTCATCTGCACCACTAATGTATATTGGAACTCTAGTTGGAGTAATAAAACTTATGGTGATATTTGGGATAACATG
ACCTGGATGCAGTGGGAGAGAGAAATTAGCAATTATACAGACATAATATATGAATTGCTTGAAGAATCACAAAACCA
GCAGGAAAAGAATGAACAAGATTTACTAGCATTGGACAGATGGAACAGTCTGTGGAATTGGTTTAACATAACAAATT
GGCTGTGGTATATAAAAATATTCATAATGATAGTAGGAGGCTTGATAGGTTAAGAATAATTTTTGCTGTGCTTTCT
TTAGTAAATAGAGTTAGGCAGGGATACTCACCTCTGTCATTGCAGACCCTTATCCCAAGCCCGAGGGGACCAGACAG
GCCCGGAGGAATCGAAGAAGAAGGTGGAGAGCAAGACAGAAACAGATCAACGCGATTAGTGAGCGGATTCTTAGCGC
TTGTCTGGGACGACCTGCGGAGCCTGTGCCTTTTCATCTACCACCGATTGAGAGACTTCATATTAATTGCAGCGAGA
GCGGGGGAACTTCTGGGACGCAGCAGTCTCAAGGGACTACGGAGAGGGTGGGAAGCCCTTAAGTATCTGGGAAGTCT
TGTGCAGTATTGGGGCCTGGAACTAAAAAGGAGTGCTATTAGTCTATTGGATACCCTAGCAATAGCAGTAGGTGAAG
GAACAGATAGGATTCTAGAATTTGTATTAGGAATTTGTAGAGCTATCCGCAACATACCTACAAGAATAAGACAGGGC
TTTGAAACAGCTTTGCTATAA
>703010505.W78.38
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCG
ATGCTACTGCCAGCAATGCTACTGCCATCAATATCAGTATAATAGAGGAAATGAAAAATTGCTCTTTCAATATAACC
ACAGAATTAAGAGATAAGAGAGAGAAAAAGAATGCACTTTTTTATAAACTTGATATAGTACAACTAGATGGCAACTC
TAGTCAGCATAGATTAATAAATTGTAATACCTCAGTCATAACACAAGCCTGTCCAAAGGTCTCTTTTGACCCAATTC
CTATACATTATTGTGCTCCAGCTGGTTATGCGATTCTAAAGTGTAATAATAAGACATTCAATGGAACAGGACCGTGT
AATAATGTCAGCACAGTACAATGTACACATGGAATTAAGCCAGTGGTTTCAACTCAACTATTGTAAATGGTAGCCT
AGCAGAAGGAGAGATAATAATTAGATCTAAAAATATAACAGACAATGGCAAAACAATAATAGTACATCTCAATGAAT
CTGTAAAGATTGAGTGTACGAGACCCAGTAATAACACAAGAACAAGTATAAGAATAGGACCAGGACAAGCATTTTAT
GCAACAGGACAAGTAATAGGAAATATAAGAGAAGCACATTGTAACATTAGTGAAAGTAAATGGAATGAAACTTTACA
AAGGGTAAGTGAAAAATTAAAAGAATACTTCCCTCATAAGAATATAACATTTCAACCATCCTCAGGAGGGGACCTAG
AAATTACAACACATAGCTTTAATTGTGGAGGAGAATTTTTCTATTGCAATACATCAAGCCTGTTTAATAGGACATAT
ATGGCTACTAGTACAGATATGGCTAATAGTACAGAAACTAACAGTACACGAATCATCACAATCCGCTGCAGAATAAA
ACAAATTATAAACATGTGGCAGGAGGTGGGACGAGCAATGTATGCCCCTCCCATTGCAGGAAACATAACATGTATAT
CAAATATCACAGGACTACTATTGACAAGGGATGGAGGAAAAAACGATACGGATACGGAGACATTCAGACCTGAAGGA
GGAAATATGAAGGACAATTGGAGAAGTGAATTATATAAATATAAAGTGGTAGAAGTTAAGCCATTAGGAGTAGCACC
CACTAATGCAAGAAGGAGAGTGGTGGAGAGAGAAAAAAGAGCAGTGGGAATGGGAGCTGTGTTCCTTGGGTTCTTGG
GAGCGGCAGGAAGCACTATGGGCGCAGCATCAATAACGCTGACGGTACAGGCCAGACAATTATTGTCTGGTATAGTG
CAACAGCAAAGCAATTTGCTGAAGGCTATAGAGGCTCAACAGCATATGTTGAAACTCACGGTCTGGGGCATTAAACA
GCTCCAGGCAAGAGTCCTGGCCTTGGAAAGATACCTAAAGGATCAACAGCTCCTAGGGATGTGGGGCTGCTCTGGAA
AACTCATCTGCACCACTAATGTATATTGGAACTCTAGTTGGAGTAATAAAACTTATGGTGATATTTGGGATAACATG
ACCTGGATGCAGTGGGAGAGAGAAATTAGCAATTATACAGACATAATATATGAATTGCTTGAAGAATCACAAAACCA
GCAGGAAAAGAATGAACAAGATTTACTAGCATTGGACAGATGGAACAGTCTGTGGAATTGGTTTAACATAACAAATT
GGCTGTGGTATATAAAAATATTCATAATGATAGTAGGAGGCTTGATAGGTTAAGAATAATTTTTGCTGTGCTTTCT
TTAGTAAATAGAGTTAGGCAGGGATACTCACCTCTGTCATTGCAGACCCTTATCCCAAGCCCGAGGGGACCAGACAG
GCCCGGAGGAATCGAAAAGAAGGTGGAGAGCAAGACAGAAACAGATCAACGCGATTAGTGAGCGGATTCTTAGCGC
TTGTCTGGGACGACCTGCGGAGCCTGTGCCTTTTCATCTACCACCGATTGAGAGACTTCATATTAATTGCAGCGAGA
GCGGGGGAACTTCTGGGACGCAGCAGTCTCAAGGGACTACGGAGAGGGTGGGAAGCCCTTAAGTATCTGGGAAGTCT
TGTGCAGTATTGGGGCCTGGAACTAAAAAGGAGTGCTATTAGTCTATTGGATACCCTAGCAATAGCAGTAGGTGAAG

FIG. 17B cont'd

GAACAGATAGGATTCTAGAATTTGTATTAGGAATTTGTAGAGCTATCCGCAACATACCTACAAGAATAAGACAGGGC
TTTGAAACAGCTTTGCTATAA
>793010505.N78.43
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGGGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTAATGCTACTGCCAGCAATAGCAGTATAATAGAGGGAATGAATAGCAGTATATTAGAGGGAATGAAAAATTGC
TCTTTCAATATAACCACAGAATTAAGAGATAAGAGAGAGAAAAAGAATGCACTTTTTTATAAACTTGATATAGTACA
ACTAGGTGGCAACTCTAGTCAGTATAGATTAATAAATTGTAATACCTCAGTCATAACACAAGCCTGTCCAAAGGTCT
CTTTTGACCCAATTCCTATACATTATTGTGCTCCAGCTGGTTATGCGATTCTAAAGTGTAATAATAAGACATTCAAT
GGAACAGGACCGTGTAATAATGTCAGCACAGTACAATGTACACATGGAATTAAGCCAGTGGTTTCAACTCAACTATT
GTTAAATGGTAGCCTAGCAGAAGGAGAGATAATAATTAGATCTAAAAATATAACAGACAATGGCAAAACAATAATAG
TACATCTCAATGAATCTGTAAAGATTGAGTGTACGAGACCCAGTAATAACACAAGAACAAGTATAAGAATAGGACCA
GGACAAGCATTTTATGCAACAGGACAAGTAATAGGAGACATAAGAGAAGCACATTGTAACATTAGTGAAAGTAAATG
GAATGAAACTTTACAAAGGGTAAGTGAAAAATTAAAAGAATACTTCCCTCATAAGAATATAACATTTCAACCATCCT
CAGGAGGGGACCTAGAAATTACAACACATAGCTTTAATTGTGGAGGAGAATTTTTCTATTGCAATACATCAAGCCTG
TTTAATAGGACATATATGGCTACTAGTACAGATATGGCTAATAGTACAGAAACTAACAGTACACGAATCATCACAAT
CCGCTGCAGAATAAAACAAATTATAAACATGTGGCAGGAGGTGGGACGAGCAATGTATGCCCCTCCCATTGCAGGAA
ACATAACATGTATATCAAATATCACAGGACTACTATTGACAAGGGATGGAGGAAAAACGATACGGATACGGAGACA
TTCAGACCTGAAGGAGGAAATATGAAGGACAATTGGAGAAGTGAATTATATAAATATAAAGTGGTAGAAGTTAAGCC
ATTAGGAGTAGCACCCACTAATGCAAGAAGGAGAGTGGTGGAGAGAGAAAAAAGAGCAGTGGGAATGGGAGCTGTGT
TCCTTGGGTTCTTGGGAGCGGCAGGAAGCACTATGGGCGCAGCATCAATAACGCTGACGGTACAGGCCAGACAATTA
TTGTCTGGTATAGTGCAACAGCAAAGCAATTTGCTGAAGGCTATAGAGGCTCAACAGCATATGTTGAAACTCACGGT
CTGGGGCATTAAACAGCTCCAGGCAAGAGTCCTGGCCTTGGAAAGATACCTAAAGGATCAACAGCTCCTAGGGATGT
GGGGCTGCTCTGGAAAACTCATCTGCACCACTAATGTATATTGGAACTCTAGTTGGAGTAATAAAACTTATGGTGAT
ATTTGGGATAACATGACCTGGATGCAGTGGGAGAGAGAAATTAGCAATTATACAGAAATAATATATGAATTGCTTGA
AGAATCACAAAACCAGCAGGAAAAGAATGAACAAGATTTACTAGCATTGGACAGATGGAACAGTCTGTGGAATTGGT
TTAACATAACAAATTGGCTGTGGTATATAAAAATATTCATAATGATAGTAGGAGGCTTGATAGGTTTAAGAATAATT
TTTGCTGTGCTTTCTTTAGTAAATAGAGTTAGGCAGGGATACTCACCTCTGTCATTGCAGACCCTTATCCCAAGCCC
GAGGGGACCAGACAGGCCCGGAGGAATCGAAGAAGAAGGTGGAGGCAAGACAGAGACAGATCAACGCGATTAGTGA
GCGGATTCTTAGCGCTTGCCTGGGACGACCTGCGGAGCCTGTGCCTTTTCATCTACCACCGATTGAGAGACTTCATA
TTAATTGCAGCGAGAGCGGGGGAACTTCTGGGACGCAGCAGTCTCAAGGGACTACGGAGAGGGTGGGAAGCCCTTAA
GTATCTGGGAAGTCTTGTGCAGTATTGGGGCCTGGAACTAAAAAGGAGTGCTATTAGTCTATTGGATACCCTAGCAA
TAGCAGTAGGTGAAGGAACAGATAGGATTCTAGAATTTGTATTAGGAATTTGTAGAGCTATCCGCAACATACCTACA
AGAATAAGACAGGGCTTTGAAACAGCTTTGCTATAA
>793010505.N78.8
ATGAGAGTGATGGGGATACAGAGGAATTATACACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGTTAATGCTACTGCCAGCAATAGCAGTATAATAGAGGGAATGAATAGCAGTATATTAGAGGGAATGAAAAATTGC
TCTTTCAATATAACCACAGAATTAAGAGATAAGAGAGAGAAAAAGAATGCACTTTTTTATAAACTTGATATAGTACA
ACTAGGTGGCAACTCTAGTCAGTATAGATTAATAAATTGTAATACCTCAGTCATAACACAAGCCTGTCCAAAGGTCT
CTTTTGACCCAATTCCTATACATTATTGTGCTCCAGCTGGTTATGCGATTCTAAAGTGTAATAATAAGACATTCAAT
GGAACAGGACCGTGTAATAATGTCAGCACAGTACAATGTACACATGGAATTAAGCCAGTGGTTTCAACTCAACTATT
GTTAAATGGTAGCCTAGCAGAAGGAGAGATAATAATTAGATCTAAAAATATAACAGACAATGGCAAAACAATAATAG
TACATCTCAATGAATCTGTAAAGATTGAGTGTACGAGACCCAGTAATAACACAAGAACAAGTATAAGAATAGGACCA
GGACAAGCATTTTATGCAACAGGACAAGTAATAGGAGACATAAGAGAAGCACATTGTAACATTAGTGAAAGTAAATG
GAATGAAACTTTACAAAGGGTAAGTGAAAAATTAAAAGAATACTTCCCTGATAAGAATATAACATTTCAACCATCCT
CAGGAGGGGACCTAGAAATTACAACACATAGCTTTAATTGTGGAGGAGAATTTTTCTATTGCAATACATCAAGCCTG
TTTAATAGGACATATATGGCTAATAGTACAGATATGGCTAATAGTACAGAAACTAACAGTACACGAATCATCACAAT
CCGCTGCAGAATAAAACAAATTATAAACATGTGGCAGGAGGTGGGACGAGCAATGTATGCCCCTCCCATTGCAGGAA
ACATAACATGTATATCAAATATCACAGGACTACTATTGACAAGGGATGGAGGAGAAAACAATACGGAGACATTCGAG
ACATTCAGACCTGGAGGAGGAAATATGAAGGACAATTGGAGAAGTGAATTATATAAATATAAAGTGGTAGAAGTTAA
GCCATTAGGAGTAGCACCCACTAATGCAAGAAGGAGAGTGGTGGAGAGAGAAAAAAGAGCAGTGGGAATGGGAGCTG
TGTTCCTTGGGTTCTTGGGAGCGGCAGGAAGCACTATGGGCGCAGCATCAATAACGCTGACGGTACAGGCCAGACAA
TTATTGTCTGGTATAGTGCAACAGCAAAGCAATTTGCTGAAGGCTATAGAGGCTCAACAGCATATGTTGAAACTCAC
GGTCTGGGGCATTAAACAGCTCCAGGCAAGAGTCCTGGCCTTGGAAAGATACCTAAAGGATCAACAGCTCCTAGGGA
TGTGGGGCTGCTCTGGAAAACTCATCTGCACCACTAATGTATATTGGAACTCTAGTTGGAGTAATAAAACTTATGGT
GATATTTGGGATAACATGACCTGGATGCAGTGGGAGAGAGAAATTAGCAATTATACAGAACTAATATATGAATTGCT
TGAAGAATCACAAAACCAGCAGGAAAAGAATGAACAAGATTTACTAGCATTGGACAGATGGAACAGTCTGTGGGACT
GGTTTAACATAACAAATTGGCTGTGGTATATAAAAATATTCATAATGATAGTAGGAGGCTTGATAGGTTTAAGAATA
ATTTTTGCTGTGCTTTCTTTAGTAAATAGAGTTAGGCAGGGATACTCACCTCTGTCATTGCAGACCCTTATCCCAAG
CCCGAGGGGACCAGACAGGCCCGGAGGAATCGAAGAAGAAGGTGGAGACAAGACAAGACAGATCAACGCGATTAG
TGAGCGGATTCTTAGCGCTTGCCTGGGACGACCTGCGGAGCCTGTGCCTTTTCATCTACCACCGATTGAGAGACTTC
ATATTAATTGCAGCGAGAGCGGGGGAACTTCTGGGACGCAGCAGTCTCAAGGGACTACGGAGAGGGTGGGAAGCCCT
TAAGTATCTGGGAAGTCTTGTGCAGTATTGGGGCCTGGAACTAAAAAGGAGTGCTATTAGTCTATTGGATACCCTAG

FIG. 17B cont'd

CAATAGCAGTAGGTGAAGGAACAGATAGGATTCTAGAATTTGTATTAGGAATTTGTAGAGCTATCCGCAACATACCT
ACAAGAATAAGACAGGGCTTTGAAACAGCTTTGCTATAA
>703010505.W78.14
ATGAGAGTGATGGGGATACAGAGGAATTATACACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGTTAATGCTACTGCCAGCAATAGCAGTATAATAGAGGGAATGAATAGCAGTATATTAGAGGGAATGAAAAATTGC
TCTTTCAATATAACCACAGAATTAAGAGATAAGAGAGAGAAAAAGAATGCACTTTTTTATAAACTTGATATAGTACA
ACTAGGTGGCAACTCTAGTCAGTATAGATTAATAAATTGTAATACCTCAGTCATAACACAAGCCTGTCCAAAGGTCT
CTTTTGACCCAATTCCTATACATTATTGTGCTCCAGCTGGTTATGCGATTCTAAAGTGTAATAATAAGACATTCAAT
GGAACAGGACCGTGTAATAATGTCAGCACAGTACAATGTACACATGGAATTAAGCCAGTGGTTTCAACTCAACTATT
GTTAAATGGTAGCCTAGCAGAAGGAGAGATAATAATTAGATCTAAAAATATAACAGACAATGGCAAAACAATAATAG
TACATCTCAATGAATCTGTAAAGATTGAGTGTACGAGACCCAGTAATAACACAAGAACAAGTATAAGAATAGGACCA
GGACAAGCATTTTATGCAACAGGACAAGTAATAGGAGACATAAGAGAAGCACATTGTAACATTAGTGAAAGTAAATG
GAATGAAACTTTACAAAGGGTAAGTGAAAAATTAAAAGAATACTTCCCTGATAAGAATATAACATTTCAACCATCCT
CAGGAGGGGACCTAGAAATTACAACACATAGCTTTAATTGTGGAGGAGAATTTTTCTATTGCAATACATCAAGCCTG
TTTAATAGGACATATATGGCTAATAGTACAGATATGGCTAATAGTACAGAAACTAACAGTACACGAATCATCACAAT
CCGCTGCAGAATAAAACAAATTATAAACATGTGGCAGGAGGTGGGAGGTGATGTATGCCCCTCCCATTGCAGGAA
ACATAACATGTATATCAAATATCACAGGACTACTATTGACAAGGGATGGAGGAGAAAACAATACGGAGACATTCGAG
ACATTCAGACCTGGAGGAGGAAATATGAAGGACAATTGGAGAAGTGAATTATATAAATATAAAGTGGTAGAAGTTAA
GCCATTAGGAGTAGCACCCACTAATGCAAGAAGGAGAGTGGTGGAGAGAGAAAAAGAGCAGTGGGAATGGGAGCTG
TGTTCCTTGGGTTCTTGGGAGCGGCAGGAAGCACTATGGGCGCAGCATCAATAACGCTGACGGTACAGGCCAGACAA
TTATTGTCTGGTATAGTGCAACAGCAAAGCAATTTGCTGAAGGCTATAGAGGCTCAACAGCATATGTTGAAACTCAC
GGTCTGGGGCATTAAACAGCTCCAGGCAAGAGTCCTGGCCTTGGAAAGATACCTAAAGGATCAACAGCTCCTAGGGA
TGTGGGGCTGCTCTGGAAAACTCATCTGCACCACTAATGTATATTGGAACTCTAGTTGGAGTAATAAAACTTATGGT
GATATTTGGGATAACATGACCTGGATGCAGTGGGAGAGAGAAATTAGCAATTATACAGAACTAATATATGAATTGCT
TGAAGAATCACAAAACCAGCAGGAAAAGAATGAACAAGATTTACTAGCATTGGACAGATGGAACAGTCTGTGGGACT
GGTTTAACATAACAAATTGGCTGTGGTATATAAAAATATTCATAATGATAGTAGGAGGCTTGATAGGTTTAAGAATA
ATTTTTGCTGTGCTTTCTTTAGTAAATAGAGTTAGGCAGGGATACTCACCTCTGTCATTGCAGACCCTTATCCCAAG
CCCGAGGGGACCAGACCGGCCCGAGGAATCGAAGAAGAAGGTGGAGAGCAAGACAGAACAGATCAACGCGATTAG
TGAGCGGATTCTTAGCGCTTGCCTGGGACGACCTGCGGAGCCTGTGCCTTTTCATCTACCACCGATTGAGAGACTTC
ATATTAATTGCAGCGAGAGCGGGGGAACTTCTGGGACGCAGCAGTCTCAAGGGACTACGGAGAGGGTGGGAAGCCCT
TAAGTATCTGGGAAGTCTTGTGCAGTATTGGGGCCTGGAACTAAAAAGGAGTGCTATTAGTCTATTGGATACCCTAG
CAATAGCAGTAGGTGAAGGAACAGATAGGATTCTAGAATTTGTATTAGGAATTTGTAGAGCTATCCGCAACATACCT
ACAAGAATAAGACAGGGCTTTGAAACAGCTTTGCTATAA
>703010505.W78.7
ATGAGAGTGATGGGGATACAGAGGAATTATACACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGTTAATGCTACTGCCAGCAATAGCAGTATAATAGAGGGAATGAATAGCAGTATATTAGAGGGAATGAAAAATTGC
TCTTTCAATATAACCACAGAATTAAGAGATAAGAGAGAGAAAAAGAATGCACTTTTTTATAAACTTGATATAGTACA
ACTAGGTGGCAACTCTAGTCAGTATAGATTAATAAATTGTAATACCTCAGTCATAACACAAGCCTGTCCAAAGGTCT
CTTTTGACCCAATTCCTATACATTATTGTGCTCCAGCTGGTTATGCGATTCTAAAGTGTAATAATAAGACATTCAAT
GGAACAGGACCGTGTAATAATGTCAGCACAGTACAATGTACACATGGAATTAAGCCAGTGGTTTCAACTCAACTATT
GTTAAATGGTAGCCTAGCAGAAGGAGAGATAATAATTAGATCTAAAAATATAACAGACAATGGCAAAACAATAATAG
TACATCTCAATGAATCTGTAAAGATTGAGTGTACGAGACCCAGTAATAACACAAGAACAAGTATAAGAATAGGACCA
GGACAAGCATTTTATGCAACAGGACAAGTAATAGGAGACATAAGAGAAGCACATTGTAACATTAGTGAAAGTAAATG
GAATGAAACTTTACAAAGGGTAAGTGAAAAATTAAAAGAATACTTCCCTGATAAGAATATAACATTTCAACCATCCT
CAGGAGGGGACCTAGAAATTACAACACATAGCTTTAATTGTGGAGGAGAATTTTTCTATTGCAATACATCAAGCCTG
TTTAATAGGACATATATGGCTAATAGTACAGATATGGCTAATAGTACAGAAACTAACAGTACACGAATCATCACAAT
CCGCTGCAGAATAAAACAAATTATAAACATGTGGCAGGAGGTGGGACGAGCAATGTATGCCCCTCCCATTGCAGGAA
ACATAACATGTATATCAAATATCACAGGACTACTATTGACAAGGGATGGAGGAGAAAACAATACGGAGACATTCGAG
ACATTCAGACCTGGAGGAGGAAATATGAAGGACAATTGGAGAAGTGAATTATATAAATATAAAGTGGTAGAAGTTAA
GCCATTAGGAGTAGCACCCACTAATGCAAGAAGGAGAGTGGTGGAGAGAGAAAAAGAGCAGTGGGAATGGGAGCTG
TGTTCCTTGGGTTCTTGGGAGCGGCAGGAAGCACTATGGGCGCAGCATCAATAACGCTGACGGTACAGGCCAGACAA
TTATTGTCTGGTATAGTGCAACAGCAAAGCAATTTGCTGAAGGCTATAGAGGCTCAACAGCATATGTTGAAACTCAC
GGTCTGGGGCATTAAACAGCTCCAGGCAAGAGTCCTGGCCTTGGAAAGATACCTAAAGGATCAACAGCTCCTAGGGA
TGTGGGGCTGCTCTGGAAAACTCATCTGCACCACTAATGTATATTGGAACTCTAGTTGGAGTAATAAAACTTATGGT
GATATTTGGGATAACATGACCTGGATGCAGTGGGAGAGAGAAATTAGCAATTATACAGAACTAATATATGAATTGCT
TGAAGAATCACAAAACCAGCAGGAAAAGAATGAACAAGATTTACTAGCATTGGACAGATGGAACAGTCTGTGGGACT
GGTTTAACATAACAAATTGGCTGTGGTATATAAAAATATTCATAATGATAGTAGGAGGCTTGATAGGTTTAAGAATA
ATTTTTGCTGTGCTTTCTTTAGTAAATAGAGTTAGGCAGGGATACTCACCTCTGTCATTGCAGACCCTTATCCCAAG
CCCGAGGGGACCAGACCGGCCCGAGGAATCGAAGAAGAAGGTGGAGAGCAAGACAGAACAGATCAACGCGATTAG
TGAGCGGATTCTTAGCGCTTGCCTGGGACGACCTGCGGAGCCTGTGCCTTTTCATCTACCACCGATTGAGAGACTTC
ATATTAATTGCAGCGAGAGCGGGGGAACTTCTGGGACGCAGCAGTCTCAAGGGACTACGGAGAGGGTGGGAAGCCCT
TAAGTATCTGGGAAGTCTTGTGCAGTATTGGGGCCTGGAACTAAAAAGGAGTGCTATTAGTCTATTGGATACCCTAG

FIG. 17B cont'd

CAATAGCAGTAGGTGAAGGAACAGATAGGATTCTAGAATTTGTATTAGGAATTTGTAGAGCTATCCGCAACATACCT
ACAAGAATAAGACAGGGCTTTGAAACAGCTTTGCTATAA
>703010505.W78.40
ATGAGAGTGATGGGGAGACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGCGTACCCACAGACCCCAATCCA
CAAGAAATGGTTTTAAAAAATGTAACAGAAAAGTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCA
ATGTTAATGCTACTGCCAGCAATAGCAGTATAATAGAGGGAATGAATAGCAGTATATTAGAGGGAATGAAAAATTGC
TCTTTCAATATAACCACAGAATTAAGAGATAAGAGAGAGAAAAAGAATGCACTTTTTTATAAACTTGATATAGTACA
ACTAGATGGCAACTCTAGTCAGTATAGATTAATAAATTGTAATACCTCAGTCATAACACAAGCCTGTCCAAGGTCT
CTTTTGACCCAATTCCTATACATTATTGTGCTCCAGCTGGTTATGCGATTCTAAAGTGTAATAATAAGACATTCAAT
GGAACAGGACCGTGTAATAATGTCAGCACAGTACAATGTACTCATGGAATTAAGCCAGTGGTTTCAACTCAACTATT
GTTAAATGGTAGCCTAGCAGAAGGAGAGATAATAATTAGATCTAAAAATATAACAGACAATGGCAAAACAATAATAG
TACATCTCAATGAATCTGTAAAGATTGAGTGTACGAGACCCAGTAATAACACAAGAACAAGTATAAGAATAGGACCA
GGACAGCATTTTATGCAACAGGACAAGTAATAGGAGACATAAGAGAAGCACATTGTAACATTAGTGAAAGTAAATG
GAATGAAACTTTACAAAGGGTAAGTGAAAAATTAAAAGAATACTTCCCTCAGAAGAATATAACATTTCAACCATCCT
CAGGAGGGGACCTAGAAATTACAACACATAGCTTTAATTGTGGAGGAGAATTTTTCTATTGCAATACATCAAGCCTG
TTTAATGAACATATATGGCTAATAGTACAGATATGGCTAATAGTACAGAAACTAACAGTACACGAATCATCACAAT
CCGCTGCAGAATAAAACAAATTATAAACATGTGGCAGGAGGTGGGACGAGCAATGTATGCCCCTCCCATTGCAGGAA
ACATAACATGTATATCAAATATCACAGGACTACTATTGACAAGGGATGGAGGAGAAAACAATACGGAGACATTCGAG
ACATTCAGACCTGGAGGAGGAAATATGAAGGACAATTGGAGAAGTGAATTATATAAATATAAAGTGGTAGAAGTTAA
GCCATTAGGAGTAGCACCCACTAATGCAAGAAGGAGAGTGGTGGAGAGAGAAAAAAGAGCAGTGGGAATGGGAGCTG
TGTTCCTTGGGTTCTTGGGAGCGGCAGGAAGCACTATGGGCGCAGCATCAATAACGCTGACGGTACAGGCCAGACAA
TTATTGTCTGGTATAGTGCAACAGCAAAGCAATTTGCTGAAGGCTATAGAGGCTCAACAGCATATGTTGAAACTCAC
GGTCTGGGGCATTAAACAGCTCCAGGCAAGAGTCCTGGCCTTGGAAAGATACCTAAAGGATCAACAGCTCCTAGGGA
TGTGGGGCTGCTCTGGAAAACTCATCTGCACCACTAATGTATATTGGAACTCTAGTTGGAGTAATAAAACTTATGGT
GATATTTGGGATAACATGACCTGGATGCAGTGGGAGAGAGAAATTAGCAATTATACAGAAAAAATATATGAATTGCT
TGAAGAATCACAAAACCAGCAGGAAAAGAATGAACAAGATTTACTAGCATTGGACAGATGGAACAGTCTGTGGAATT
GGTTTAACATAACAAATTGGCTGTGGTATATAAAAATATTCATAATGATAGTAGGAGGCTTGATAGGTTTAAGAATA
ATTTTTGCTGTGCTTTCTTTAGTAAATAGAGTTAGGCAGGGATACTCACCTCTGTCGTTGCAGACCCTTATCCCAAG
CCCGAGGGGACCAGACAGGCCCGGAGGAATCGAAGAAGAAGGTGGAGACCAAGACAGAAACAGATCAACGCGATTAG
TGAGCGGATTCTTAGCGCTTGCCTGGGACGACCTGCGGAGCCTGTGCCTTTTCATCTACCACCGATTGAGAGACTTC
ACATTAATTGCAGCGAGAGCGGGGGAACTTCTGGGACGCAGCAGTCTCAAGGGACTATGGAGAGGATGGGAAGCCCT
TAAGTATCTGGGAAGTCTTGTGCAGTATTGGGGCCTGGAACTAAAAAGGAGTGCTATTAGTCTATTGGATACCCTAG
CAATAGCAGTAGGTGAAGGAACAGATAGGATTCTAGAATTTGTATTAGGAATTTGTAGAGCTATCCGCAACATACCT
ACAAGAATAAGACAGGGCTTTGAAACAGCTTTGCTATAA
>703010505.W100.C2
GAGAGTGATGGGGATACAGAGGAATTATCCACAATGGTGGATATGGAGCATGTTAGGCTTTTGGATGCTAATGATTT
GTAATGGGATGTGGGTCACAGTCTACTATGGGGTACCTGTGTGGAAAGAAGCAAAAACTACTCTATTCTGTGCATCA
GATGCTAAAGCATATGAGAAAGAAGTGCATAATGTCTGGGCTACACATGCCTGTGTACCCACAGACCCCAATCCACA
AGAAATGGTTTTAAAAAATGTAACAGAAAATTTCAACATGTGGAAAAATGACATGGTGGATCAGATGCATGAAGATG
TAATTAGTTTATGGGATCAAAGCCTCAAGCCATGTGTAAAGGTTGACCCCACTCTGTGTCACTCTAAACTGTATCAAT
GCTACTAATGCTACTGCCAGCAAGAGCAGTATATTAGAGGGAATGAAAAATTGCTCTTTCAATATAACCACAGAATT
AAGAGATAAGAGAGAGAAAAAGAATGCACTTTTTTATAAACTTGATATAGTACAACTAGATGGCAACTCTAGTCAGT
ATAGATTAATAAATTGTAATACCTCAGTCATAACACAAGCCTGTCCAAAGGTCTCTTTTGACCCAATTCCTATACAT
TATTGTGCTCCAGCTGGTTATGCGATTCTAAAGTGTAATAATAAGACATTCAATGGAACAGGACCGTGTAATAATGT
CAGCACAGTACAATGTACACATGGAATTAAGCCAGTGGTTTCAACTCAACTATTGTTAAATGGTAGCCTAGCAGAAG
GAGAGATAATAATTAGATCTAAAAATATAACAGACAATGGCAAAACAATAATAGTACATCTCAATGAATCTGTAAAG
ATTGAGTGTACGAGACCCAGTAATAACACAAGAACAAGTATAAGAATAGGACCAGGACAAGCATTTTATGCAACAGG
ACAAGTAATAGGAAATATAAGAGAAGCACATTGTAACATTAGTGAAAGTAAATGGAATGAAACTTTACAAAGGGTAA
GTGAAAAATTAAAAGAATACTTCCCTCATAAGAATATAACATTTCAACCATCCTCAGGAGGGGACCTAGAAATTACA
ACACATAGCTTTAATTGTGGAGGAGAATTTTTCTATTGCAATACATCAAGCCTGTTTAATAGGACATATATGGTTAA
TAGTACAGATATGGCTAATAGTACAGAAACTAACAGTACACGAACCATCCAATCAGCTGCAGAATAAAACAAATTA
TAAACATGTGGCAGGAGGTGGGACGAGCAATGTATGCCCCTCCCATTGCAGGAAACATAACATGTATATCAAATATC
ACAGGACTACTATTGACAAGGGATGGAGGAAACGATACGGATACGGAGACATTCAGACCTGAAGGAGGAAATATGAA
GGACAATTGGAGAAGTGAATTATATAAATATAAAGTGGTAGAAGTTAAGCCATTAGGAGTAGCACCCACTAATGCAA
GAAGGAGAGTGGTGGAGAGAGAAAAAAGAGCAGTGGGAATGGGAGCCGTGTTCCTTGGGTTCTTGGGAGCGGCAGGA
AGCACTATGGGCGCAGCATCAATAACGCTGACGGTACAGGCCAGACAATTATTGTCTGGTATAGTGCAACAGCAAAG
CAATTTGCTGAAGGCTATAGAGGCTCAACAGCATATGTTGAAACTCACGGTCTGGGGCATTAAACAGCTCCAGGCAA
GAGTCCTGGCCTTGGAAAGATACCTAAAGGATCAACAGCTCCTAGGGATGTGGGGCTGCTCTGGAAAACTCATCTGC
ACCACTAATGTATATTGGAACTCTAGTTGGAGTAATAAAACTTATGGTGATATTTGGGATAACATGACCTGGATGCA
GTGGGAGAGAGAAATTAGCAATTACACAGAAAATATATATGAATTGCTTGAAGAATCACAAAACCAGCAGGAAAAGA
ATGAACAAGATTTACTAGCATTGGACAGATGGAACAGTCTGTGGAATTGGTTTAACATAACAAATTGGCTGTGGTAT
ATAAAAATATTCATAATGATAGTAGGAGGCTTGATAGGTTTAAGAATAATTTTTGCTGTGCTTTCTTTAGTAAATAG
AGTTAGGCAGGGATACTCACCTCTGTCATTGCAGACCCTTATCCCAAGCCCGAGGGGACCAGACAGGCCCGGAGGAA
TCGAAGAAGAAGGTGGAGAGCAAGACAGAAACAGATCAACGCGATTAGTGAGCGGATTCTTAGCGCTTGCCTGGGAC
GACCTGCGGAGCCTGTGCCTTTTCATTTACCACCGATTGAGAGACTTCATATTAATTGCAGCGAGAGTGGGGGAACT
TCTGGGACGCAACAGTCTCAAGGGACTACGGAGAGGGTGGGAAGCCCTTAAGTATCTGGGAAGTCTTGTGCAGTATT
GGGGCCTGGAACTAAAAAGGAGTGCTATTAGTCTATTGGATACCCTAGCAATAGCAGTAGGTGAAGGAACAGATAGG

FIG. 17B cont'd

ATTCTAGAATTTGTATTAGGAATTTGTAGAGCTATCCGCAACATACCTACAAGAATAAGACAGGGCTTTGAAACAGC
TTTGCTATAA
>793010505.W100.T3
ATGAGAGTGAGGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGCCAGCAATAGCAGTATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGATGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATGGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAAACTTTACAAAGGGT
AAGTGAAAAATTAAAAGAATACTTCCCTCACAAGAATATAACATTTCAACCATCCTCAGGAGGGGACCTAGAAATTA
CAACACATAGCTTTAATTGTAGAGGAGAATTTTTCTATTGCAATACATCAAGCCTGTTTAATAGGACATATATGGCT
ACTAGTACAGATATGGCTAATAGTACAGAAACTAACAGTACACGAATCATCACAATCCGCTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGGGGAGAAAACGATACGGAGACATTCAGACCTGAAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGTTGGAGTAATAAAACTTATAGTGATATTTGGGATAACATGACCTGG
ATGCAGTGGGAGAGAGAAATTAGCAATTATACAGAACTAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCCAGACAGGCCCGG
AGGAATCGAAGAAGAAGGTGGAGAGCAAGACAGAAACAGATCAACGCGATTAGTGAGCGGATTCTTAGCGCTTGTCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAAGGAACAG
ATAGGATTCTAGAATTTGTATTAGGAATTTGTAGAGCTATCCGCAACATACCTACAAGAATAAGACAGGGCTTTGAA
ACAGCTTTGCTATAA
>793010505.W100.A6
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGCCAGCAATAGCAGTATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGATGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCATGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATGGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAAACTTTACAAAGGGT
AAGTGAAAAATTAAAAGAATACTTCCCTCAGAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGAACATATATGGCT
ACTAGTACAGATATGGCTAATAGTACAGAAACTAACAGTACACGAATCATCACAATCCGCTGCAGGATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAACGATACGGATACGGAGACATTCAGACCTGAAGGAGGAAATATG
AAGGACAATTGGAGAAGTGAATTATATAAATATAAAGTGGTAGAAGTTAAGCCATTAGGAGTAGCACCCACTAATGC
AAGAAGGAGAGTGGTGGAGAGAGAAAAAGAGCAGTGGGAATGGAGCTGTGTTCCTTGGGTTCTTGGGAGCGGCAG
GAAGCACTATGGGCGCAGCAGCAATAACGCTGACGGTACAGGCCAGACAATTGTCTGGTATAGTGCAACAGCAA
AGCAATTTGCTGAAGGCTATAGAGGCTCAACAGCATATGTTGAAACTCACGGTCTGGGGCATTAAACAGCTCCAGGC
AAGAGTCCTGGCCTTGAAAGATACCTAAAGGATCAACAGCTCCTAGGGATGTGGGGCTGCTCTGGAAAACTCATCT
GCACCACTAATGTATATTGGAACTCTAGTTGGAGTAATAAAACTTATGGTGATATTTGGGATAACATGACCTGGATG
CAGTGGGAGAGAGAAATTAGCAATTATACAGACATAATATATGAATTGCTTGAAGAATCACAAAACCAGCAGGAAAA
GAATGAACAAGATTTACTAGCATTGGACAGATGGAACAGTCTGTGGAATTGGTTTAACATAACAAATTGGCTGTGGT
ATATAAAAATATTCATAATGATAGTAGGAGGCTTGATAGGTTTAAGAATAATTTTTGCTGTGCTTTCTTTAGTAAAT
AGAGTTAGGCAGGGATACTCACCTCTGTCATTGCAGACCCTTATCCCAAGCCCGAGGGGACCCAGACAGGCCCGGAG
GAATCGAAGAAGAAGGTGGAGAGCAAGACAGAAACAGATCAACGCGATTAGTGAGCGGATTCTTAGCGCTTGCCTGGG
ACGACCTGCGGAGCCTGTGCCTTTTCATCTACCACCGATTGAGAGACTTCATATTAATTGCAGCGAGAGCGGGGAA
CTTCTGGGACGCAGCAGTCTCAAGGGACTACGGAGAGGGTGGGAAGCCCTTAAGTATCTGGGAAGTCTTGTGCAGTA
TTGGGGCCTGGAACTAAAAAGGAGTGCTATTAGTCTATTGGATACCCTAGCAATAGCAGTAGGTGAAGGAACAGATA

FIG. 17B cont'd

```
GGATTCTAGAATTTGTATTAGGAATTTGTAGAGCTATCCGCAACATACCTACAAGAATAAGACAGGGCTTTGAAACA
GCTTTGCTATAA
>703010505.W190.A12
ATGAGAGTGAGGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAGGTTGACCCCACTCTGTGTCACTCTAAACTGTATCA
ATGCTACTAATGCTACTGCCAGCAATAGCAGTATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGATGGCAACTCTAGTCA
ATATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATGGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAGACATAAGAGAAGCACATTGTAACATTAGTGAAAGTAAATGGAATGAAACTTTACAAAGGGT
AAGTGAAAAATTAAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
AATAGTACAGATATGGCTAATAGTACAGAAACTAACAGTACACGAATCATCACACTCCACTGCAGAATAAAACAAAT
TATAAACATGTGGCAGGAGGTGGGACGAGCAATGTATGCCCCTCCCATTGCAGGAAATATAACATGTATATCAAATA
TCACAGGACTACTATTGACAAGGGATGGAGGGAACGATACGGATACGGAGACATTCAGACCTGAAGGAGGAAATATG
AAGGACAATTGGAGAAGTGAATTATATAAATATAAAGTGGTAGAAGTTAAGCCATTAGGAGTAGCACCCACTAATGC
AAGAAGGAGAGTGGTGGAGAGAGAAAAAAGAGCAGTGGGAATGGGAGCTGTGTTCCTGGGTTCTTGGGAGCGGCAG
GAAGCACTATGGGCGCAGCATCAATAACGCTGACGGTACAGGCCAGACAACTATTGTCTGGTATAGTGCAACAGCAA
AGCAATTTGCTGAAGGCTATAGAGGCTCAACAGCATATGTTGAAACTCACGGTCTGGGGCATTAAACAGCTCCAGGC
AAGAGTCCTGGCCTTGAAAGATACCTAAAGGATCAACAGCTCCTAGGGATGTGGGGCTGCTCTGGAAAACTCATCT
GCACCACTAATGTATATTGGAACTCTAGTTGGAGTAATAAAACTTATGGTGATATTTGGGATAACATGACCTGGATG
CAGTGGGAGAGAGAAATTAGCAATTATACAGACATAATATATGAATTGCTTGAAGAATCACAAAACCAGCAGGAAAA
GAATGAACAAGATTTACTAGCATTGGACAGATGGAACAGTCTGTGGAATTGGTTTAACATAACAAATTGGCTGTGGT
ATATAAAAATATTCATAATGATAGTAGGAGGCTTGATAGGTTTAAGAATAATTTTTGCTGTGCTTTCTTTAGTAAAT
AGAGTTAGGCAGGGATACTCACCTCTGTCATTGCAGACCCTTATCCCAAGCCCGAGGGGACCAGACAGGCCCGGAGG
AATCGAAGAAGGAGGTGGAGAGCAAGACAGAAACAGATCAACGCGATTAGTGAGCGGATTCTTAGCGCTTGCCTGGG
ACGACCTGCGGAGCCTGTGCCTTTTCATCTACCACCGATTGAGAGACTTCATATTAATTGCAGCGAGAGCGGGGAA
CTTCTGGGACGCAGCAGTCTCAAGGGACTACGGAGAGGGTGGGAAGCCCTTAAGTATCTGGGAAGTCTTGTGCAGTA
TTGGGGCCTGGAACTAAAAAGGAGTGCTATTAGTCTATTGGATACCCTAGCAATAGCAGTAGGTGAAGGAACAGATA
GGATTCTAGAATTTGTATTAGGAATTTGTAGAGCTATCCGCAACATACCTACAAGAATAAGACAGGGCTTTGAAACA
GCTTTGCTATAA
>703010505.W190.C1
ATGAGAGTGAGGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAGGTTGACCCCACTCTGTGTCACTCTAAACTGTATCA
ATGCTACTAATGCTACTGCCAGCAATAGCAATATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGATGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATGGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAGACATAAGAGAAGCACATTGTAACATTAGTGAAAGTAAATGGAATGAAACTTTACAAAGGGT
AAGTGAAAAATTAAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
AATAGTACAGATATGGCTAATAGTACAGAAACTAACAGTACACGAATCATCACACTCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTATTGACAAGGGATGGAGGAAAAACGATACGGAGACATTCAGACCTGAAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGCTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGAAAAGATACCTAAAGGATCAACAGCTCCTAGGGATGTGGGGCTGCTCTGGAAAACTCA
TCTGCACCACTAATGTATATTGGAACTCTAGTTGGAGTAATAAAACTTATGGTGATATTTGGGATAACATGACCTGG
ATGCAGTGGGAGAGAGAAATTAGCAATTATACAGACATAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCAGACAGGCCCGG
AGGAATCGAAGAAGGAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAAGGAACAG
```

FIG. 17B cont'd

```
ATAGGATTCTAGAATTTGTATTAGGAATTTGTAGAGCTATCCGCAACATACCTACAAGAATAAGACAGGGCTTTGAA
ACAGCTTTGCTATAA
>703010505.W100.A9
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAGGTTGACCCCACTCTGTGTCACTCTAAACTGTATCA
ATGCTACTAATGCTACTGCCAGCAATAGCAGTATATTAGAGGGAATGAAAAATTGCTCTTTCAATATAACCACAGAA
TTAAGAGATAAGAGAGAGAAAAAAGAATGCACTTTTTTTATAAACTTGATATAGTACAACTAGATGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAACATAACAGACAATGGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAGACATAAGAGAAGCACATTGTAACATTAGTGAAAGTAAATGGAATGAAACTTTACAAAGGGT
AAGTGAAAAATTAAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
ACTAATACAGATATGGCTAATAGTACAGAAACTAACAGTACACGAATCATCACAATCCGCTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAAAACGATACGGATACGGAGACATTCAGACCTGAAGGAGGAAATA
TGAAGGACAATTGGAGAAGTGAATTATATAAATATAAAGTGGTAGAAGTTAAGCCATTAGGAGTAGCACCCACTAAT
GCAAGAAGGAGAGTGGTGGAGAGAGAAAAAAGAGCAGTGGGAATGGGAGCTGTGTTCCTTGGGTTCTTGGGAGCGGC
AGGAAGCACTATGGGCGCAGCATCAATAACGCTGACGGTACAGGCCAGACAATTATTGTCTGGTATAGTGCAACAGC
AAAGCAATTTGCTGAAGGCTATAGAGGCTCAACAGCATATGTTGAAACTCACGGTCTGGGGCATTAAACAGCTCCAG
GCAAGAGTCCTGGCCTTGGAAAGATACCTAAAGGATCAACAGCTCCTAGGGATGTGGGGCTGCTCTGGAAAACTCAT
CTGCACCACTAATGTATATTGGAACTCTAGTTGGAGTAATAAAACTTATGGTGATATTTGGGATAACATGACCTGGA
TGCAGTGGGAGAGAGAAATTAGCAATTATACAGACATAATATATGAATTGCTTGAAGAATCACAAAACCAGCAGGAA
AAGAATGAACAAGATTTACTAGCATTGGACAGATGGAACAGTCTGTGGAATTGGTTTAACATAACAAATTGGCTGTG
GTATATAAAAATATTCATAATGATAGTAGGAGGCTTGATAGGTTTAAGAATAATTTTTGCTGTGCTTTCTTTAGTAA
ATAGAGTTAGGCAGGGATACTCACCTCTGTCATTGCAGACCCTTATCCCAAGCCCGAGGGGACCAGACAGGCCCGGA
GGAATCGAAGAAGAAGGTGGAGAGCAAGACAGAAACAGATCAACGCGATTAGTGAGCGGATTCTTAGCGCTTGCCTG
GGACGACCTGCGGAGCCTGTGCCTTTTCATCTACCACCGATTGAGAGACTTCATATTAATTGCAGCGAGAGCGGGGG
AACTTCTGGGACGCAGCAGTCTCAAGGGACTACGGAGAGGGTGGGAAGCCCTTAAGTATCTGGGAAGTCTTGTGCAG
TATTGGGGCCTGGAACTAAAAAGGAGTGCTATTAGTCTATTGGATACCCTAGCAATAGCAGTAGGTGAAGGAACAGA
TAGGATTCTAGAATTTGTATTAGGAATTTGTAGAGCTATCCGCAACATACCTACAAGAATAAGACAGGGCTTTGAAA
CAGCTTTGCTATAA
>703010505.W100.A7
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAGGTTGACCCCACTCTGTGTCACTCTAAACTGTATCA
ATGCTACTAATGCTACTGCCAGCAATAGCAGTATATTAGAGGGAATGAAAAATTGCTCTTTCAATATAACCACAGAA
TTAAGAGATAAGAGAGAGAAAAAGAATGCACTTTTTTTATAAACTTGATATAGTACAACTAGATGGCAACTCTAGTCA
GTATAGATTAATAAATTGTAATACCTCAGTCATAACACAAGCCTGTCCAAAGGTCTCTTTTGATCCAATTCCTATAC
ATTATTGTGCTCCAGCTGGTTATGCGATTCTAAAGTGTAATAATAAAACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAACATAACAGACAATGGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAGACATAAGAGAAGCACATTGTAACATTAGTGAACGTAAATGGAATGAAACTTTACAAAGGGT
AAGTGAAAAATTAAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGTCTGTTTAATAGGACATATATGGTT
AATAGTACAGATATGGCTAATAGTACAGAAACTAACAGTACACGAACCATCACAATCAGCTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAAAACGATACGGATACGGAGACATTCAGACCTGAAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGCTGCTCTGGAAAACTCA
TCTGCACCACTAATGTATATTGGAACTCTAGTTGGAGTAATAAAACTTATGGTGATATTTGGGATAACATGACCTGG
ATGCAGTGGGAGAGAGAAATTAGCAATTATACAGACATAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAAGGAACAG
```

FIG. 17B cont'd

ATAGGATTCTAGAATTTGTATTAGGAATTTGTAGAGCTATCCGCAACATACCTACAAGAATAAGACAGGGCTTTGAA
ACAGCTTTGCTATAA
>703010505.W100.A4
ATGAGAGTGATGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAGGTTGACCCCACTCTGTGTCACTCTAAACTGTATCA
ATGCTACTAATGCTACTGCCAGCAATAGCAGTATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGATGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCCGTGTAATAAT
GTCAGCACAGTACAATGTACGCATGGAATTAAGCCAGTGGTTTCAACTCAACTATTGTTAAATGGTAGCCTAGCAGA
AGGAGAGATAATAATTAGATCTAAAAATATAACAGACAATGGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAGACATAAGAGAAGCACATTGTAACATTAGTGAAAGTAAATGGAATGAAACTTTACAAAGGGT
AAGTGAAAAATTAAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAATCTGTTTAATAGGACATATATGGTT
AATAGTACAGATATGGCTAATAGTACAGAAACTAACAGTACACGAACCATCACAATCAGCTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAAAAACGATACGGATACGGAGACATTCAGACCTGAAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGTTGGAGTAATAAAACTTATGGTGATATTTGGGATAACATGACCTGG
ATGCAGTGGGAGAGAGAAATTAGCAATTATACAGAACTAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAAGGAACAG
ATAGGATTCTAGAATTTGTATTAGGAATTTGTAGAGCTATCCGCAACATACCTACAAGAATAAGACAGGGCTTTGAA
ACAGCTTTGCTATAA
>703010505.W100.B10
ATGAGAGTGATGGGGAGACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGCCAGCAATAGCAGTATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGATGGCAACTCTAGTCA
GTATAGATTAATAAATTGTAATACCTCAGTCATAACACAAGCCTGTCCAAAGGTCTCTTTTGACCCAATTCCAATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGATAATAATTAGATCTAAAAATATAACAGACAATGGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAGACATAAGAGAAGCACATTGTAACATTAGTGAAAGTAAATGGAATGAAACTTTACAAAGGGT
AAGTAAAAAATTAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGTT
AATAGTACAGATATGGCTAATAGTACAGAAACTAACAGTACACGAACCATCACAATCAGCTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAAAAACGATACGGATACGGAGACATTCAGACCTGAAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGTTGGAGTAATAAAACTTATGGTGATATTTGGGATAACATGACCTGG
ATGCAGTGGGAGAGAGAAATTAGCAATTATACAGAACTAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAAGGAACAG

FIG. 17B cont'd

ATAGGATTCTAGAATTTGTATTAGGAATTTGTAGAGCTATCCGCAACATACCTACAAGAATAAGACAGGGCTTTGAA
ACAGCTTTGCTATAA
>793016505.W190.A10
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTACTAATGCTACTGCCAGCAATAGCAGTATATTAGGGGGGAATGAAAAATTGCTCTTTTCAATATAACCACAGAA
TTAAGAGATAAGAGAGAGAAAAAGAATGCACTTTTTTATAAACTTGATATAGTACAACTAGATGGCAACTCTAGTCA
GTATAGATTAATAAATTGTAATACCTCAGCCATAACACAAGCCTGTCCAAAGGTCTCTTTTGACCCAATTCCTATAC
ATTATTGCGCTCCAGCTGGTTATGCGATTCTAAAGTGTAATAATAAGACATTCAATGGAACAGGACCATGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAACATAACAGACAATGGCAAAACAATAATAGTACATCTCAATGAATCTGTAA
AGATTGAGTGTACGAGACCCAGTAATAACACAAGAACAGTATAAGAATAGGACCAGGACAGCATTTTATGCAACA
GGACAAGTAATAGGAGACATAAGAGAAGCACATTGTAACATTAGTGAAAGTAAATGGAATGAAACTTTACAAAGGGT
AAGTGAAAAATTAAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
AATAGTACAGATATGGCTAATAGTACAGAAACTAACAGTACACGAATCATCACAATCCGCTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAAAAATGATACGGATACGGAGACATTCAGACCTGAAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGTTGGAGTAATAAAACTTATGGTGATATTTGGGATAACATGACCTGG
ATGCAGTGGGAGAGAGAAATTAGCAATTATACAGAACTAATATATGAATTGCTTGAAGAATCACAAAACCAGCAGGA
AAAGAATGAACAAGATTTACTAGCATTGGACAGATGGAACAGTCTGTGGAATTGGTTTAACATAACAAACTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCAGACAGGCCCGG
AGGAATCGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAAGGAACAG
ATAGGATTCTAGAATTTGTATTAGGAATTTGTAGAGCTATCCGCAACATACCTACAAGAATAAGACAGGGCTTTGAA
ACAGCTTTGCTATAA
>793016505.W190.A3
ATGAGAGTGATGGGGATACAGAAGAATTGTCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACTG
ATGCTAATGCTACTGCCAGCAATAGCAGTATAATAAAGGGAATGAATAGCAGTATGATAGAGGGAAATGAAAAATTGC
TCTTTCAATATAACCACAGAATTAAGAGATAAGAGAGAGAAAAAGAATGCACTTTTTTATAAACTTGATATAGTACA
ACTAGATGGCAACTCTAGTCAGTATAGATTAATAAATTGTAATACCTCAGTCATAACACAAGCCTGTCCAAAGGTCT
CTTTTGACCCAATTCCTATACATTATTGTGCTCCAGCTGGTTATGCGATTCTAAAGTGTAATAATAAGACATTCAAT
GGAACAGGACCGTGTAATAATGTCAGCACAGTACAATGTACACATGGAATTAAGCCAGTGGTTTCAACTCAACTATT
GTTAAATGGTAGCCTAGCAGAAGGAGAGATAATAATTAGATCTAAAAATATAACAGACAATGGCAAAACAATAATAG
TACATCTCAATGAATCTGTAAAGATTGAGTGTACGAGACCCAGTAATAACACAAGAACAAGTATAAGAATAGGACCA
GGACAAGCATTTTATGCAACAGGACAAGTAATAGGAGACATAAGAGAAGCACATTGTAACATTAGTGAAAGTAAATG
GAATGAAACTTTACAAGGGTAAGTGAAAAATTAAAAGAATACTTCCCTGATAAGAATATAACATTTCAACCATCCT
CAGGAGGGGACCTAGAAATTACAACACATAGCTTTAATTGTGGAGGAGAATTTTTCTATTGCAATACATCAAGCCTG
TTTAATAGGACATATATGGCTACTAGTACAGATATGGCTAATAGTACAGAAACTAACAGTACACGAATCATCACAAT
CCGCTGCAGAATAAAACAAATTATAAACATGTGGCAGGAGGTGGGACGAGCAATGTATGCCCCTCCCATTGCAGGAA
ACATAACATGTATATCAAATATCACAGGACTACTATTGACAAGGGATGGAGGAGAAAACGATACGGATACGGAGACA
TTCAGACCTGAAGGAGGAAATATGAAGGACAATTGGAGAAGTGAATTATATAAATATAAAGTGGTAGAAGTTAAGCC
ATTAGGAGTAGCACCCACTAATGCAAGAAGGAGAGTGGTGGAGAGAGAAAAAAGAGCAGTGGGAATGGGAGCTGTGT
TCCTTGGGTTCTTGGGAGCGGCAGGAAGCACTATGGGCGCAGCATCAATAACGCTGACGGTACAGGCCAGACAATTA
TTGTCTGGTATAGTGCAACAGCAAAGCAATTTGCTGAAGGCTATAGAGGCTCAACAGCATATGTTGAAACTCACGGT
CTGGGGCATTAAACAGCTCCAGGCAAGAGTCCTGGCCTTGGAAAGATACCTAAAGGATCAACAGCTCCTAGGGATGT
GGGGCTGCTCTGGAAAACTCATCTGCACCACTAATGTATATTGGAACTCTAGTTGGAGTAATAAAACTTATGGTGAT
ATTTGGGATAACATGACCTGGATGCAGTGGGAGAGAGAAATTAGCAATTATACAGACATAATATATGAATTGCTTGA
AGAATCACAGAACCAGCAGGAAAAGAATGAACAAGATTTACTAGCATTGGACAGATGGAACAGTCTGTGGAATTGGT
TTAACATAACAAATTGGCTGTGGTATATAAAAATATTCATAATGATAGTAGGAGGCTTGATAGGTTTAAGAATAATT
TTTGCTGTGCTTTCTTTAGTAAATAGAGTTAGGCAGGGATACTCACCTCTGTCATTGCAGACCCTTATCCCAAGCCC
GAGGGGACCAGACAGGCCCGGAGGAATCGAAGAAGAAGGTGGAGAGCAAGACAGAAACAGATCAACGCGATTAGTGA
GCGGATTCTTAGCGCTTGCCTGGGACGACCTGCGGAGCCTGTGCCTTTTCATCTACCACCGATTGAAAGACTTCATA
TTAATTGCAGCGAGAGCGGGGGAACTTCTGGGACGCAGCAGTCTCAAGGGACTACGGAGAGGGTGGGAAGCCCTTAA
GTATCTGGGAAGTCTTGTGCAGTATTGGGGCCTGGAACTAAAAAGGAGTGCTATTAGTCTATTGGATACCCTAGCAA

FIG. 17B cont'd

```
TAGCAGTAGGTGAAGGAACAGATAGGATTCTAGAATTTGTATTAGGAATTTGTAGAGCTATCCGCAACATACCTACA
AGAATAAGACAGGGCTTTGAAACAGCTTTGCTATAA
>703010505.W100.B8
ATGAGAGTGAGGGGGATACAGAGGAATTATCCACAATGGTGGATATGGAGCATGTTAGGCTTTTGGATGCTAATGAT
TTGTAATGGAATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTAGATCAGATGCATGAAGA
TGTAATTAGTTTATGGGATCAAAGCCTCAAGCCATGTGTAAAGTTGACCCCACTCTGTGTCACTCTAAACTGTACCG
ATGCTAATGCTACTGCCAGCAATAGCAGTATAATAAAGGGAATGAATAGCAGTATGATAGAGGAAATGAAAAATTGC
TCTTTCAATATAACCACAGAATTAAGAGATAAGAGAGAGAAAAAGAATGCACTTTTTTATAAACTTGATATAGTACA
ACTAGATGGCAACTCTAGTCAGTATAGATTAATAAATTGTAATACCTCAGTCATAACACAAGCCTGTCCAAAGGTCT
CTTTTGACCCAATTCCTATACATTATTGTGCTCCAGCTGGTTATGCGATTCTAAAGTGTAATAATAAGACATTCAAT
GGAACAGGACCGTGTAATAATGTCAGCACAGTACAATGTACACATGGAATTAAGCCAGTGGTTTCAACTCAACTATT
GTTAAATGGTAGCCTAGCAGAAGGAGAGATAATAATTAGATCTAAAAATATAACAGACAATGGCAAAACAATAATAG
TACATCTCAATGAATCTGTAAAGATTGAGTGTACGAGACCCAGTAATAACACAAGAACAAGTATAAGAATAGGACCA
GGACAAGCATTTTATGCAACAGGACAAGTAATAGGAGACATAAGAGAAGCACATTGTAACATTAGTGAAAGTAAATG
GAATGAAACTTTACAAAGGGTAAGTGAAAAATTAAAAGAATACTTCCCTGATAAGAATATAACATTTCAACCATCCT
CAGGAGGGGACCTAGAAATTACAACACATAGCTTTAATTGTGGAGGAGAATTTTTCTATTGCAATACATCAAGCCTG
TTTAATAGGACATATATGGCTAATAGTACAGATATGGCTAATAGTACAGAAACTAACAGTACACGAATCATCACACT
CCACTGCAGAATAAAACAAATTATAAACATGTGGCAGGAGGTGGGACGAGCAATGTATGCCCCTCCCATTGCAGGAA
ACATAACATGTATATCAAATATCACAGGACTACTATTGCAAGGGATGGAGGAAAAAACGATACGGATACGGAGACA
TTCAGACCTGTAGGAGGAAATATGAAGGACAATTGGAGAAGTGAATTATATAAATATAAAGTGGTAGAAGTTAAGCC
ATTAGGAGTAGCACCCACTAAGGCAAGAAGGAGAGTGGTGGAGAGAGAAAAAGAGCAGTGGGAATGGGAGCTGTGT
TCCTTGGGTTCTTGGGAGCGGCAGGAAGCACTATGGGCGCAGCATCAATAACGCTGACGGTACAGGCCAGACAATTA
TTGTCTGGTATAGTGCAACAGCAAAGCAATTTGCTGAAGGCTATAGAGGCTCAACAGCATATGTTGAAACTCACGGT
CTGGGGCATTAAACAGCTCCAGGCAAGAGTCCTGGCCTTGGAAAGATACCTAAAGGATCAACAGCTCCTAGGGATGT
GGGGCTGCTCTGGAAAACTCATCTGCACCACTAATGTATATTGGAACTCTAGTTGGAGTAATAAAACTTATGGTGAT
ATTTGGGATAACATGACCTGGATGCAGTGGGAGAGAGAAATTAGCAATTATACAGAACTAATATATGAATTGCTTGA
AGAATCACAAAACCAGCAGGAAAAGAATGAACAAGATTTACTAGCATTGGACAGATGGAACAGTCTGTGGAATTGGT
TTAACATAACAAATTGGCTGTGGTATATAAAAATATTCATAATGATAGTAGGAGGCTTGATAGGTTTAAGAATAATT
TTTGCTGTGCTTTCTTTAGTAAATAGAGTTAGGCAGGGATACTCACCTCTGTCATTGCAGACCCTTATCCCAAGCCC
GAGGGGACCAGACAGGCCCGGAGGAATCGAAGAAGAAGGTGGAGAGCAAGACAGAAACAGATCAACGCGATTAGTGA
GCGGATTCTTAGCGCTTGCCTGGGACGACCTGCGGAGCCTGTGCCTTTTCATCTACCACCGATTGAGAGACTTCATA
TTAATTGCAGCGAGAGCGGGGGAACTTCTGGGACGCAGCAGTCTCAAGGGACTACGGAGAGGGTGGGAAGCCCTTAA
GTATCTGGGAAGTCTTGTGCAGTATTGGGGCCTGGAACTAAAAAGGAGTGCTATTAGTCTATTGGATACCCTAGCAA
TAGCAGTAGGTGAAGGAACAGATAGGATTCTAGAATTTGTATTAGGAATTTGTAGAGCTATCCGCAACATACCTACA
AGAATAAGACAGGGCTTTGAAACAGCTTTGCTATAA
>703010505.W100.B2
ATGAGAGTGATGGGGATACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAAAGCAAAAACTACTCTATTTTGTGCAT
CAGATGCTAAAGCATATGAGAAAGAAGTGCATAGTGTCTGGGCTACACATGCCTGTGTACCCACAGACCCCAATCCA
CAAGAAATGGTTTTAAAAAATGTAACAGAAAATTTCAACATGTGGAAAAATGACATGGTAGATCAGATGCATGAAGA
TGTAATTAGTTTATGGGATCAAAGCCTCAAGCCATGTGTAAAGTTGACCCCACTCTGTGTCACTCTAAACTGTACCG
ATGCTAATGCTACTGCCAGCAATAGCAGTATAATAAAGGGAATGAATAGCAGTATGATAGAGGAAATGAAAAATTGC
TCTTTCAATATAACCACAGAATTAAGAGATAAGAGAGAGAAAAAGAATGCACTTTTTTATAAACTTGATATAGTACA
ACTAGATGGCAACTCTAGTCAGTATAGATTAATAAATTGTAATACCTCAGTCATAACACAAGCCTGTCCAAAGGTCT
CTTTTGACCCAATTCCTATACATTATTGTGCTCCAGCTGGTTATGCGATTCTAAAGTGTAATAATAAGACATTCAAT
GGAACAGGACCGTGTAATAATGTCAGCACAGTACAATGTACACATGGAATTAAGCCAGTGGTTTCAACTCAACTATT
GTTAAATGGCAGCCTAGCAGAAGGAGAGATAATAATTAGATCTGAAAATATAACACAGTGTCAAAACAATAATAG
TACATCTCAATGAATCTGTAAAGATTGAGTGTACGAGACCCAGTAATAACACAAGAACAAGTATAAGAATAGGACCA
GGACAAGCATTTTATGCAACAGGACAAGTAATAGGAGACATAAGAAAAGCACATTGTAACATTAGTGAAAGTAAATG
GAATGAAACTTTACAAAGGGTAAGTAAAAAATTAAAAGAATACTTCCCTGATAGGAATATAACATTTCAACCATCCT
CAGGAGGGGACCCAGAAATTACAACACATAGCTTTAATTGTGGAGGAGAATTTTTCTATTGCAATACATCAAGCCTG
TTTAATAGAACATATATGGCTAATAGTACAGATATGGCTAATAGTACAGAAACTAACAGTACACGAATCATCACAAT
CCGCTGCAGAATAAAACAATTATAAACATGTGGCAGGAGGTGGGACGAGCAATGTATGCCCCTCCCATTGCAGGAA
ACATAACATGTATATCAAATATCACAGGACTACTATTGACAAGGGATGGAGGAAATAACAATACGGAGACATTCAGA
CCTGTAGGAGGAAATATGAAGGACAATTGGAGAAGTAAATTATATAAATATAAAGTGGTAGAAGTTAAGCCATTAGG
AGTAGCACCCACTAAGGCAAGAAGGAGAGATGGTGGAGAGAGAAAAAAGAGCAGTGGAATGGGAGCTGTGTTCCTTG
GGTTCTTGGGAGCGGCAGGAAGCACTATGGGCGCAGCATCAATAACGCTGACGGTACAGGCCAGACAATTATTGTCT
GGTATAGTGCAACAGCAAAGCAATTTGCTGAAGGCTATAGAGGCTCAACAGCATATGTTGAAACTCACGGTCTGGGG
CATTAAACAGCTCCAGGCAAGAGTCCTGGCCTTGGAAAGATACCTAAAGGATCAACAGCTCCTAGGGATGTGGGGCT
GCTCTGGAAAACTCATCTGCACCACTAATGTATATTGGAACTCTAGTTGGAGTAATAAAACTTATGGTGATATTTGG
GATAACATGACCTGGATGCAGTGGGAGAGAGAAATTAGCAATTATACAGAAATAATATATGACTTGCTTGAAGAATC
ACAAAACCAGCAGGAAAAGAATGAACAAGATTTACTAGCATTGGACAGATGGACACGTCTGTGGAATTGGTTTAACA
TAACAAAATGGCTGTGGTATATAAAAATATTCATAATGATAGTAGGAGGCTTGATAGGTTTAAAAATAATTTTTGCT
GTGCTTTCTTTAGTAAATAGAGTTAGGCAGGGATACTCACCTCTGTCGTTCAGACCCTTATCCCAAGCCCGAGGGG
ACCAGACAGGCCCGGAGGAATCGAAGAAGAAGGTGGAGAGCAAGACAGAAACAGATCAACGCGATTAGTGAGCGGAT
TCTTAGCGCTTGCCTGGGACGACCTGCGGAGCCTGTGCCTTTTCATCTACCACCGATTGAGAGACTTTATATTAATT
GCAGCGAGAGCGGGGGAACTTCTGGGACGCAGCAGTCTCAAGGGACTACGGAGAGGATGGGAAGCCCTTAAGTATCT
GGAAGGTCTTGTGCAGTATTGGGGCCTGGAACTAAAAAGGAGTGCTATTAGTCTATTGGATACCCTAGCAATAGCAG
```

FIG. 17B cont'd

```
TAGGTGAAGGAACAGATAGGATTCTAGAATTTGTATTAGGAATTTGTAGAGCTATCCGCAACATACCTACAAGAATA
AGACAGGGCTTTGAAACAGCTTTGCTATAA
>703010505.W100.B4
ATGAGAGTGATGGGGAGGCAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGGAAAATGACATGGTAGATCAGATGCATGAAGA
TGTAATTAGTTTATGGGATCAAAGCCTCAAGCCATGTGTAAAGTTGACCCCACTCTGTGTCACTCTAAACTGTACCG
ATGCTAATGCTACTGCCAGCAATACCAATGCTACTGCCAGCAATATCAATGCTACTGCCAGCAAGAACAGTATAATA
GAGGAAATGAAAAATTGCTCTTTCAATATAACCACAGAATTAAGAGATAAGAGAGAGAAAAAGTATGCACTTTTTA
TAAACTTGATATAGTACAACTAGATGGCAACTCTAGTCAGTATAGATTAATAAATTGTAATACCTCAGTCATAACAC
AAGCCTGTCCAAAGGTCTCTTTTGACCCAATTCCTATACATTATTGTGCTCCAGCTGGTTATGCGATTCTAAAGTGT
AATAATAAGACATTCAATGGAACAGGACCGTGTAATAATGTCAGCACAGTACAATGTACACATGGAATTAAGCCAGT
GGTTTCAACTCAACTATTGTTAAATGGTAGCCTAGCAGAAGGAGAGATAATAATTAGATCTAAAAATATAACAGACA
ATGGCAAAACAATAATAGTACATCTCAATGAATCTGTAAAGATTGAATGTACGAGACCCAGTAATAACACAAGAACA
AGTATAAGAATAGGACCAGGACAAGCATTTTATGCAACAGGACAAGTAATAGGAGACATAAGAGAAGCACATTGTAA
CATTAGTGAAAGTAAATGGAATGAAACTTTACAAAGGGTAAGTAAAAAATTAAAAGAATACTTCCCTGATAAGAATA
TAACATTTCAATCATCCTCAGGAGGGGACCCAGAAATTACAACACATAGCTTTAATTGTGGAGGAGAATTTTTCTAT
TGCAATACATCAAGCCTGTTTAATAGGACATATATGGCTAATAGTACAGATATGGCTAATAGTACAGAAACTAACAG
TACACGAATCATCACAATCCGCTGCAGAATAAAACAAATTATAAACATGTGGCAGGAGGTGGGACGAGCAATGTATG
CCCCTCCCATTGCAGGAAACATAACATGTATATCAAATATCACAGGACTACTATTGACAAGGGATGGAGGAAACAGC
AGTACGGAGACATTCAGACCTGAAGGAGGAAATATGAAGGACAATTGGAGAAGTGAATTATATAAATATAAAGTGGT
AGAAGTTAAGCCATTAGGAGTAGCACCCACTAATGCAAGAAGGAGAGTGGTGGAGAGAGAAAAAAGAGCAGTGGGAA
TGGGAGCTGTGTTCCTTGGGTTCTTGGGAGCGGCAGGAAGCACTATGGGCGCAGCATCAATAACGCTGACGGTACAG
GCCAGACAATTATTGTCTGGTATAGTGCAACAGCAAAGCAATTTGCTGAAGGCTATAGAGGCTCAACAGCATATGTT
GAAACTCACGGTCTGGGGCATTAAACAGCTCCAGGCAAGAGTCCTGGCCTTGGAAAGATACCTAAAGGATCAACAGC
TCCTAGGGATGTGGGGCTGCTCTGGAAAACTCATCTGCACCACTAATGTATATTGGAACTCTAGTTGGAGTAATAAA
ACTTATGATGATATTTGGGATAACATGACCTGGATGCAGTGGGAGAGAGAAATTAGCAATTATACAGAAATGATATA
TGACTTGCTTGAAGAATCACAAAACCAGCAGGAAAAGAATGAACAAGATTTACTAGCATTGGACAGATGGAACAGTC
TGTGGAATTGGTTTAACATAACAAAATGGCTGTGGTATATAAAAATATTCATAATGATAGTAGGAGGCTTGATAGGT
TTAAGAATAATTTTTGCTGTGCTTTCTTTAGTAAATAGAGTTAGGCAGGGATACTCACCTCTGTCGTTGCAGACCCT
TATCCCAAGCCCGAGGGGACCAGACAGGCCCGGAGGAATCGAAGAAGAAGGTGGAGAGCAAGACAAGACAGAAGAGATCAA
CGCGATTAGTGAGCGGATTCTTAGCGCTTGTCTGGGACGACCTGCGGAGCCTGTGCCTTTTCATCTACCACCGATTG
AGAGACTTCATATTAATTGCAGCGAGAGCGGGGGAACTTCTGGGACGCAGCAGTCTCAAGGGACTACGGAGAGGGTG
GGAAGCCCTTAAGTATCTGGGAAGTCTTGTGCAGTATTGGGGCCTGGAACTAAAAAGGAGTGCTATTAGTTTATTGG
ATACCCTAGCAATAGCAGTACGTGAAGGAACAGATAGGATTCTAGAATTTGTATTAGGAATTTGTAGAGCTATCCGC
AACATACCTACAAGAATAAGACAGGGCTTTGAAACAGCTTTGCTATAA
>703010505.W100.C7
ATGAGAGTGATGGGGATACAGAGGAATTATCCACAATGGTGGATATGGAGCATGTTAGGCTTGTGGATGCTAATGAC
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCCACACATGCCTGTGTACCCACAGACCCCAATCCA
CAAGAAATGGTTTTAAAAAATGTAACAGAAAATTTCAACATGTGGGAAAATGACATGGTAGATCAGATGCATGAAGA
TGTAATTAGTTTATGGGATCAAAGCCTCAAGCCATGTGTAAAGTTGACCCCACTCTGTGTCACTCTAAACTGTACCG
ATGCTAATGCTACTGCCAGCAATACCAATGCTACTGCCAGCAATATCAATGCTACTGCCAGCAAGAGCAGTATAATA
GAGGAAATGAAAAATTGCTCTTTCAATATAACCACAGAATTAAGAGATAAGAGAGAGAAAAAGTATGCACTTTTTTA
TAAACTTGATATAGTACAACTAGATGGCAACTCTAGTCAGTATAGATTAATAAATTGTAATACCTCAGTCATAACCC
AAGCCTGTCCAAAGGTCTCTTTTGACCCAATTCCTATACATTATTGTGCTCCAGCTGGTTATGCGATTCTAAAGTGT
AATAATAAGACATTCAATGGAACAGGACCGTGTAATAATGTCAGCACAGTACAATGTACACATGGAATTAAGCCAGT
GGTTTCAACTCAACTATTGTTAAATGGTAGCCTAGCAGAAGGAGAGATAATAATTAGATCTAAAAATATAACAGACA
ATGGCAAAACAATAATAGTACATCTCAATGAATCTGTAAAGATTGAATGTACGAGACCCAGTAATAACACAAGAACA
AGTATAAGAATAGGACCAGGACAAGCATTTTATGCAACAGGACAAGTAATAGGAGACATAAGAGAAGCACATTGTAA
CATTAGTGAAAGTAAATGGAATGAAACTTTACAAAGGGTAAGTAAAAAATTAAAAGAATACTTCCCTGATAAGAATA
TAACATTTCAATCATCCTCAGGAGGGGACCCAGAAATTACAACACATAGCTTTAATTGTGGAGGAGAATTTTTCTAT
TGCAATACATCAAGCCTGTTTAATAGGACATATATGGCTAATAGTACAGATATGGCTAATAGTACAGAAACTAACAG
TACACGAATCATCACAATCCACTGCAGAATAAAACAAATTATAAACATGTGGCAGGAGGTGGGACGAGCAATGTATG
CCCCTCCCATTGCAGGAAACATAACATGTATATCAAATATCACAGGACTACTATTGACAAGGGATGGAGGAGAAAAC
AATGGAGGAAAAAACAATACAGAGACATTCAGACCTGGAGGAGGAAATATGAAGGACAATTGGAGAAGTGAATTATA
TAAATATAAAGTGGTAGAAGTTAAGCCATTAGGAGTAGCACCCACTAAGGCAAGAAGGAGAGTGGTGGAGAGAGAAA
AAAGAGCAGTGGAATGGGAGCTGTGTTCCTTGGGTTCTTGGGAGCGGCAGGAAGCACTATGGGCGCAGCATCAATA
ACGCTGACGGTACAGGCCAGACAATTATTGTCTGGTATAGTGCAACAGCAAAGCAATTTGCTGAAGGCTATAGAGGC
TCAACAGCATATGTTGAAACTCACGGTCTGGGGCATTAAACAGCTCCAGGCAAGAGTCCTGGCCTTGGAAAGATACC
TAAAGGATCAACAGCTCCTAGGGATGTGGGGCTGCTCTGGAAAACTCATCTGCACCACTAATGTATATTGGAACTCT
AGTTGGAGTAATAAAACTTATGGTGATATTTGGGATAACATGACCTGGATGCAGTGGGAGAGAGAAATTAGCAATTA
TACAGACATAATATATGACTTGCTTGAAGAATCACAAAACCAGCAGGAAAAGAATGAACAAGATTTACTAGCATTGG
ACAGATGGAACAGTCTGTGGAATTGGTTTAACATAACAAAATGGCTGTGGTATATAAAAATATTCATAATGATAGTA
GGAGGCTTGATAGGTTTAAGAATAATTTTTGCTGTGCTTTCTTTAGTAAATAGAGTTAGGCAGGGATACTCACCTCT
GTCATTGCAGACCCTTATCCCAAGCCCGAGGGGACCAGACAGGCCCGGAGGAATCGAAGAAGAAGGTGGAGAGCAAG
ACAGAAACAGATCAACGCGATTAGTGAGCGGATTCTTAGCGCTTGCCTGGGACGACCTGCGGAGCCTGTGCCTTTTC
ATCTACCACCGATTGAGAGACTTCATATTAATTGCAGCGAGAGCGGGGGAACTTCTGGGACGCAGCAGTCTCAAGGG
ACTACGGAGAGGGTGGGAAGCCCTTAAGTATCTGGGAGGTCTTGTGCAGTATTGGGGCCTGGAACTAAAAAGGAGTG
```

FIG. 17B cont'd

```
CTATTAGTCTATTGGATACCCTAGCAATAGCAGTAGGTGAAGGAACAGATAGGATTCTAGAATTTGTATTAGGAATT
TGTAGAGCTATCCGCAACATACCTACAAGAATAAGACAGGGCTTTGAAACAGCTTTGCTATAA
>703010505.W100.T2
ATGAGAGTGATGGGGATACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTCGGGCTACACATGCCTGTGTACCCACAGACCCCAATCCA
CAAGAAATGGTTTTAAAAAATGTAACAGAAAATTTCAACATGTGGGAAAATGACATGGTAGATCAGATGCATGAAGA
TGTAATTAGTTTATGGGATCAAAGCCTCAAGCCATGTGTAAAGTTGACCCCACTCTGTGTCACTCTAAACTGTACCG
ATGCTAATGCTACTGCCAGCAATATCAATGCTACTACCAGCAAGAGCAGTATAATAGAGGAAATGAAAAATTGCTCT
TTCAATATAACCACAGAATTAAGAGATAAGAGAGAGAAAAAGTATGCACTTTTTTATAAACTTGATATAGTACAACT
AGATGGCAACTCTAGTCAGTATAGATTAATAAATTGTAATACCTCAGTCATAACACAAGCCTGGCCAAAGGTCTCTT
TTGACCCAATTCCTATACATTATTGTGCTCCAGCTGGTTATGCGATTCTAAAGTGTAATAATAAGACATTCAATGGA
ACAGGACCGTGTAATAATGTCAGCACAGTACAATGTACACATGGAATTAAGCCAGTGGTTTCAACTCAACTATTGTT
AAATGGTAGCCTAGCAGAAGGAGAGATAATAATTAGACCTAAAAATATAACAGACAATGGCAAAACAATAATAGTAC
ATCTCAATGAATCTGTAAAGATTGAATGTACGAGACCCAGTAATAACACAAGAACAAGTATAAGAATAGGACCAGGA
CAAGCATTTTATGCAACAGGACAAGTAATAGGAGACATAAGAGAAGCACATTGTAACATTAGTGAAAGTAAATGGAA
TGAAACTTTACAAAGGGTAAGTAAAAAATTAAAAGAATACTTCCCTGATAAGAATATAACATTTCAATCATCCTCAG
GAGGGGACCCAGAAATTACAACACATAGCTTTAATTGTGGAGGAGAATTTTTCTATTGCAATACATCAAGCCTGTTT
AATAGGACAGATATGGCTAATAGTACAGAAACTAACAGTACACGAATCATCACAATCCGCTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAGAAAACAATGGAGGAAAAAACAATACAGAGACATTCAGACCTGGA
GGAGGAAATATGAAGGACAATTGGAGAAGTGAATTATATAAATATAAAGTGGTAGAAGTTAAGCCATTAGGAGTAGC
ACCCACTAAGGCAAGAAGGAGAGTGGTGGAGAGAGAAAAAAGAGCAGTGGGAATGGGAGCTGTGTTCCTTGGGTTCT
TGGGAGCGGCAGGAAGCACTATGGGCGCAGCATCAATAACGCTGACGGTACAGGCCAGACAATTATTGTCTGGTATA
GTGCAACAGCAAAGCAATTTGCTGAAGGCTATAGAGGCTCAACAGCATATGTTGAAACTCACGGTCTGGGGCATTAA
ACAGCTCCAGGCAAGAGTCCTGGCCTTGGAAAGATACCTAAAGGATCAACAGCTCCTAGGGATGTGGGGCTGCTCTG
GAAAACTCATCTGCACCACTAATGTATATTGGAACTCTAGTTGGAGTAATAAAACTTATGGTGATATTTGGGATAAC
ATGACCTGATGCAGTGGGAGAGAGAAATTAGCAATTATACAGACATAATATATGACTTGCTTGAAGAATCACAAAAA
CCAGCAGGAAAAGAATGAACAAGATTTACTAGCATTGGACAGATGGAACAGTCTGTGGAATTGGTTTAACATAACAA
AATGGCTGTGGTATATAAAAATATTCATAATGATAGTAGGAGGCTTGATAGGTTTAAGAATAATTTTTGCTGTGCTT
TCTTTAGTAAATAGAGTTAGGCAGGGATACTCACCTCTGTCATTGCAGACCCTTATCCCAAGCCCGAGGGGACCAGA
CAGGCCCGGAGGAATCGAAGAAGAAGGTGGAGAGCAAGACAGAAACAGATCAACGCGATTAGTGAGCGGATTCTTAG
CGCTTGCCTGGGACGACCTGCGGAGCCTGTGCCTTTTCATCTACCACCGATTGAGAGACTTCATATTAATTGCAGCG
AGAGCGGGGGAACTTCTGGGACGCAGCAGTCTCAAGGGACTACGAGAGGGTGGGAAGCCCTTAAGTATCTGGGAGG
TCTTGTGCAGTATTGGGGCCTGGAACTAAAAAGGAGTGCTATTAGTCTATTGGATACCCTAGCAATAGCAGTAGGTG
AAGGAACAGATAGGATTCTAGAATTTGTATTAGGAATTTGTAGAGCTATCCGCAACATACCTACAAGAATAAGACAG
GGCTTTGAAACAGCTTTGCTATAA
>703010505.W100.B7
GAGAGTGATGGGGATACAGAGGAATTATCCACAATGGTGGATATGGAGCATGTTAGGCTTTTGGATGCTAATGATTT
GTAATGGGATGTGGGTCACAGTCTACTATGGGGTACCTGTGTGGAAAGAAGCAAAAACTACTCTATTTTGTGCATCA
GATGCTAAAGCATATGAGAAAGAAGTGCATAATGTCTGGGCTACACATGCCTGTGTACCCACAGACCCCAATCCACA
AGAAATGGTTTTAAAAAATGTAACAGAAAATTTCAACATGTGGAAAATGACATGGCGGATCAGATGCATGAAGATG
TAATTAGTTTATGGGATCAAAGCCTCAAGCCATGTGTAAAGTTGACCCCACTCTGTGTCACTCTAAACTGTACCGAT
GCTAATGCTACTGCCAGCAATATCAATGCTACTGCCAGCAAGAGCAGTATAATAGAGGAAATGAAAAATTGCTCTTT
CAATATAACCACAGAATTAAGAGATAAGAGAGAGAAAAAGTATGCACTTTTTTATAAACTTGATATAGTACAACTAG
ATGGCAACTCTAGTCAGTATAGATTAATAAATTGTAATACCTCAGTCATAACCCAAGCCTGTCCAAAGGTCTCTTTT
GACCCAATTCCTATACATTATTGTGCTCCAGCTGGTTATGCGATTCTAAAGTGTAATAATAAGACATTCAATGGAAC
AGGACCGTGTAATAATGTCAGCACAGTACAATGTACACATGGAATTAAGCCAGTGGTTTCAACTCAACTATTGTTAA
ATGGTAGCCTAGCAGAAGGAGAGATAATAATTAGATCTGAAAATATAACAGACAATGGCAAAACAATAATAGTACAT
CTCAATGAATCTGTAAAGATTGAGTGTACAAGACCCAGTAATAACACAAGAACAAGTATAAGAATAGGACCAGGACA
AGCATTTTATGCAACAGGACAAGTAATAGGAGACATAAGAGAAGCACATTGTAACATTAGTGAAAGTAAATGGAATG
AAACTTTACAAAGGGTAAGTAAAAAATTAAAAGAATACTTCCCTGATAAGAATATAACATTTCAACCATCCTCAGGA
GGGGACCCAGAAATTACAACACATAGCTTTAATTGTGGAGGAGAATTTTTCTATTGCAATACATCAAGCCTGTTTAA
TAGGACATACATGGCTAATAGTACAGAAACTAACAGTACACGAATCACACTTCCACCTGCAGAATAAAACAAATTA
TAAACATGTGGCAGGAGGTGGGACGAGCAATGTATGCCCCTCCCATTGCAGGAAACATAACATGTATATCAAATATC
ACAGGACTACTATTGACAAGGGATGGAGGAGAAAACAAGGGATGGAGGAAATAACAATACGGAGACATTCAGACC
TGAAGGAGGAAATATGAAGGACAATTGGAGAAGTGAATTATATAAATATAAAGTGGTAGAAGTTAAGCCATTAGGAG
TAGCACCCACTAAGGCAAGAAGGAGAGTGGTGGAGAGAGAAAAAAGAGCAGTGGGAATGGGAGCTGTGTTCCTTGGG
TTCTTGGGAGCGGCAGGAAGCACTATGGGCGCAGCATCAATAACGCTGACGGTACAGGCCAGACAATTATTGTCTGG
TATAGTGCAACAGCAAAGCAATTTGCTGAAGGCTATAGAGGCTCAACAGCATATGTTGAAACTCACGGTCTGGGGCA
TTAAACAGCTCCAGGCAAGAGTCCTGGCCTTGGAAAGATACCTAAAGGATCAACAGCTCCTAGGGATGTGGGGCTGC
TCTGGAAAACTCATCTGCACCACTAATGTATATTGGAACTCTAGTTGGAGTAATAAAACTTATGGTGATATTTGGGA
TAACATGACCTGGATGCAGTGGGAGAGAGAAATTAGCAATTATACAGACATAATATATGAATTGCTTGAAGAATCAC
AAAACCAGCAGGAAAAGAATGAACAAGATTTACTAGCATTGGACAGATGGAACAGTCTGTGGAATTGGTTTAACATA
ACAAATTGGCTGTGGTATATAAAAATATTCATAATGATAGTAGGAGGCTTGATAGGTTTAAGAATAATTTTTGCTGT
GCTTTCTTTAGTAAATAGAGTTAGGCAGGGATACTCACCTCTGTCATTGCAGACCCTTATCCCAAGCCCGAGGGGAC
CAGACAGGCCCGGAGGAATCGAAGAAGAAGGTGGAGAGCAAGACAGAAACAGATCAACGCGATTAGTGAGCGGATTC
TTAGCGCTTGCCTGGGACGACCTGCGGAGCCTGTGCCTTTTCATCTACCACCGATTGAGAGACTTCATATTAATTGC
AGCGAGAGCGGGGGAACTTCTGGGACGCAGCAGTCTCAAGGGACTACGAGAGGGTGGGAAGCCCTTAAGTATCTGG
GAAGTCTTGTGCAGTATTGGGGCCTGGAACTAAAAAGGAGTGCTATTAGTCTATTGGATACCCTAGCAATAGCAGTA
```

FIG. 17B cont'd

```
GGTGAAGGAACAGATAGGATTCTAGAATTTGTATTAGGAATTTGTAGAGCTATCCGCAACATACCTACAAGAATAAG
ACAGGGCTTTGAAACAGCTTTGCTATAA
>703010505.W100.A11
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGCGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTAATGCTACTGCCAGCAATATCAATGCTACTGCCAGCAAGAGCAGTATAATAGAGGAAATGAAAAATTGCTCT
TTCAATATAACCACAGAATTAAGAGATAAGAGAGAGAAAAAGTATGCACTTTTTTATAAACTTGATATAGTACAACT
AGATGGCAACTCTAGTCAGTATAGATTAATAAATTGTAATACCTCAGTCATAACCCAAGCCTGTCCAAAGGTCTCTT
TTGACCCAATTCCTATACATTATTGTGCTCCAGCTGGTTATGCGATTCTAAAGTGTAATAATAAGACATTCAATGGA
ACAGGACCGTGTAATATGTCAGCACAGTACAATGTACAGGAATTAAGCACCAGTGGTTTCAACTCAACTATTGTT
AAATGGTAGCCTAGCAGAAGGAGAGATAATAATTAGATCTGAAAATATAACAGACAATAGCAAAACAATAATAGTAC
ATCTCAATGAATCTGTAAAGATTGAGTGTACAAGACCCAGTAATAACACAAGAACAAGTATAAGAATAGGACCAGGA
CAAGCATTTTATGCAACAGGACAAGTAATAGGAGACATAAGAGAAGCACATTGTAACATTAGTGAAAGTAAATGGAA
TGAAACTTTACAAAGGGTAAGTAAAAAATTAAAAGAATACTTCCCTGATAAGAATATAACATTTCAACCATCCTCAG
GAGGGGACCCAGAAATTACAACACATAGCTTTAATTGTGGAGGAGAATTTTTCTATTGCAATACATCAAGCCTGTTT
AATAGGACATACATGGCTAATAGTACAGAAACTAACAGTACGAACCATCACACTCCACTGCAGAATAAAACAAAT
TATAAACATGTGGCAGGAGGTGGGACGAGCAATGTATGCCCCTCCCATTGCGGAAACATAACATGTATATCAAATA
TCACAGGACTACTATTGACAAGGGATGGAGGAGAAAACACAAGGGATGGAGGAAATAACAATACGGAGACATTCAGA
CCTGAAGGAGGAAATATGAAGGACAATTGGAGAAGTGAATTATATAAATATAAAGTGGTAGAAGTTAAGCCATTAGG
AGTAGCACCCACTAAGGCAAGAAGGAGAGTGGTGGAGAGAGAAAAAAGAGCAGTGGGAATGGGAGCTGTGTTCCTTG
GGTTCTTGGGAGCGGCAGGAAGCACTATGGGCGCAGCATCAATAACGCTGACGGTACAGGCCAGACAATTATTGTCT
GGTATAGTGCAACAGCAAAGCAATTTGCTGAAGGCTATAGAGGCTCAACAGCATATGTTGAAACTCACGGTCTGGGG
CATTAAACAGCTCCAGGCAAGAGTCCTGGCCTTGGAAAGATACCTAAAGGATCAACAGCTCCTAGGGATGTGGGGCT
GCTCTGGAAAACTCATCTGCACCACTAATGTATATTGGAACTCTAGTTGGAGTAATAAAACTTATGGTGATATTTGG
GATAACATGACCTGGATGCAGTGGGAGAGAGAAATTAGCAATTATACAGACATAATATATGAATTGCTTGAAGAATC
ACAAAACCAGCAGGAAAAGAATGAACAAGATTTACTAGCATTGGACAGATGGAACAGTCTGTGGAATTGGTTTAACA
TAACAAATTGGCTGTGGTATATAAAAATATTCATAATGATAGTAGGAGGCTTGATAGGTTTAAGAATAATTTTTGCT
GTGCTTTCTTTAGTAAATAGAGTTAGGCAGGGATACTCACCTCTGTCATTGCAGACCCTTATCCCAAGCCCGAGGGG
ACCAGACAGGCCCGGAGGAATCGAAGAAGAAGGTGGAGAGCAAGACAGAAACAGATCAACGCGATTAGTGAGCGGAT
TCTTAGCGCTTGCCTGGGACGACCTGCGGAGCCTGTGCCTTTCATCTACCACCGATTGAGAGACTTCATATTAATT
GCAGCGAGAGCGGGGGAACTTCTGGGACGCAGCAGTCTCAAGGGACTACGGAGAGGGTGGGAAGCCCTTAAGTATCT
GGGAAGTCTTGTGCAGTATTGGGGCCTGGAACTAAAAAGGAGTGCTATTAGTCTATTGGATACCCTAGCAATAGCAG
TAGGTGAAGGAACAGATAGGATTCTAGAATTTGTATTAGGAATTTGTAGAGCTATCCGCAACATACCTACAAGAATA
AGACAGGGCTTTGAAACAGCTTTGCTATAA
>703010505.W100.B5
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGCGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTAATGCTACTGCCAGCAATACCAATGCTACTGCCAGCAATATCAATGCTACTGCCAGCAAGAGCAGTATAATA
GAGGAAATGAAAAATTGCTCTTTCAATATAACCACAGAATTAAGAGATAAGAGAGAGAAAAAAATATGCACTTTTTT
ATAAACTTGATATAGTACAACTAGATGGCAACTCTAGTCAGTATAGATTAATAAATTGTAATACCTCAGTCATAACC
CAAGCCTGTCCAAAGGTCTCTTTTGACCCAATTCCTATACATTATTGTGCTCCAGCTGGTTATGCGATTCTAAAGTG
TAATAATAAGACATTCAATGGAACAGGACCGTGTAATAATGTCAGCACAGTACAATGTACACATGGAATTAAGCCAG
TGGTTTCAACTCAACTATTGTTAAATGGTAGCCTAGCAGAAGGAGAGATAATAATTAGATCTGAAAATATAACAGAC
AATAGCAAAACAATAATAGTACATCTCAATGAATCTGTAAAGATTGAGTGTACAAGACCCAGTAATAACACAAGAAC
AAGTATAAGAATAGGACCAGGACAAGCATTTTATGCAACAGGACAAGTAATAGGAGACATAAGAGAAGCACATTGTA
ACATTAGTGAAAGTAAATGGAATGAAACTTTACAAAGGGTAAGTAAAAAATTAAAAGAATACTTCCCTGATAAGAAT
ATAACATTTCAACCATCCTCAGGAGGGGACCCAGAAATTACAACACATAGCTTTAATTGTGGAGGAGAATTTTTCTA
TTGCAATACATCAAGCCTGTTTAATAGGACATACATGGCTAATAGTACAGAAACTAACAGTACGAACCATCACAC
TCCACTGCAGAATAAAACAAATTATAAACATGTGGCAGGAGGTGGGACGAGCAATGTATGCCCCTCCCATTGCAGGA
AACATAACATGTATATCAAATATCACAGGACTACTATTGACAAGGGATGGAGGAGAAAACACAAGGGATGGAGGAAA
TAACAATACGGAGACATTCAGACCTGAAGGAGGAAATATGAAGGACAATTGGAGAAGTGAATTATATAAATATAAAG
TGGTAGAAGTTAAGCCATTAGGAGTAGCACCCACTAAGGCAAGAAGGAGAGTGGTGGAGAGAGAAAAAAGAGCAGTG
GGAATGGAGCTGTGTTCCTTGGGTTCTTGGGAGCGGCAGGAAGCACTATGGGCGCAGCATCAATAACGCTGACGGT
ACAGGCCAGACAATTATTGTCTGGTATAGTGCAACAGCAAAGCAATTTGCTGAAGGCTATAGAGGCTCAACAGCATA
TGTTGAAGCTCACGGTCTGGGCATTAAACAGCTCCAGGCAAGAGTCCTGGCCTTGGAAAGATACCTAAAGGATCAA
CAGCTCCTAGGGATGTGGGGCTGCTCTGGAAAACTCATCTGCACCACTAATGTATATTGGAACTCTAGTTGGAGTAA
TAAAACTTATGGTGATATTTGGGATAACATGACCTGGATGCAGTGGGAGAGAGAAATTAGCAATTATACAGACATAA
TATATGAATTGCTTGAAGAATCACAAAACCAGCAGGAAAAGAATGAACAAGATTTACTAGCATTGGACAGATGGAAC
AGTCTGTGGAATTGGTTTAACATAACAAATTGGCTGTGGTATATAAAAATATTCATAATGATAGTAGGAGGCTTGAT
AGGTTTAAGAATAATTTTTGCTGTGCTTTCTTTAGTAAATAGAGTTAGGCAGGGATACTCACCTCTGTCATTGCAGA
CCCTTATCCCAAGCCCGAGGGGACCAGACAGGCCCGGAGGAATCGAAGAAGAAGGTGGAGAGCAAGACAGAAACAGA
TCAACGCGATTAGTGAGCGGATTCTTAGCGCTTGCCTGGGACGACCTGCGGAGCCTGTGCCTTTCATCTACCACCG
ATTGAGAGACTTCATATTAATTGCAGCGAGAGCGGGGGAACTTCTGGGACGCAGCAGTCTCAAGGGACTACGGAGAG
GGTGGGAAGCCCTTAAGTATCTGGGAAGTCTTGTGCAGTATTGGGGCCTGGAACTAAAAAGGAGTGCTATTAGTCTA
```

FIG. 17B cont'd

```
TTGGATACCCTAGCAATAGCAGTAGGTGAAGGAACAGATAGGATTCTAGAATTTGTATTAGGAATTTGTAGAGCTAT
CCGCAACATACCTACAAGAATAAGACAGGGCTTTGAAACAGCTTTGCTATAA
>703010505.W100.C3
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGCGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTAATGCTACTGCCAGCAATACTAATGCTACTGCCAGCAATATCAATGCTACTGCCAGCAAGAGCAGTATAATA
GAGGAAATGAAAAATTGCTCTTTCAATATAACCACAGAATTAAGAGATAAGAGAGAGAAAAAGTATGCACTTTTTTA
TAAACTTGATATAGTACAACTAGATGGCAACTCTAGTCAGTATAGATTAATAAATTGTAATACCTCAGTCATAACCC
AAGCCTGTCCAAAGGTCTCTTTTGACCCAATTCCTATACATTATTGTGCTCCAGCTGGTTATGCGATTCTAAAGTGT
AATAATAAGACATTCAATGGAACAGGACCGTGTAATAATGTCAGCACAGTACAATGTACACATGGAATTAAGCCAGT
GGTTTCAACTCAACTATTGTTAAATGGTAGCCTAGCAGAAGGAGAGATAATAATTAGATCTGAAAATATAACAGACA
ATAGCAAAACAATAATAGTACATCTCAATGAATCTGTAAAGATTGAGTGTACAAGACCCAGTAATAACACAAGAACA
AGTATAAGAATAGGACCAGGACAAGCATTTTATGCAACAGGACAAGTAATAGGAGACATAAGAGAAGCACATTGTAA
CATTAGTGAAAGTAAATGGAATGAAACTTTACAAAGGGTAAGTAAAAAATTAAAAGAATACTTCCCTGATAAGAATA
TAACATTTCAACCATCCTCAGGAGGGGACCCAGAAATTACAACACATAGCTTTAATTGTGGAGGAGAATTTTTCTAT
TGCAATACATCAAGCCTGTTTAATAGGACATACATGGCTAATAGTACAGAAACTAACAGTACACGAACCATCACACT
CCACTGCAGAATAAAACAAATTATAAACATGTGGCAGGAGGTGGGACGAGCAATGTATGCCCCTCCCATTGCAGGAA
ACATAACATGTATATCAAATATCACAGGACTACTATTGACAAGGGATGGAGGAGAAAACACAAGGGATGGAGGAAAT
AACAATACGGAGACATTCAGACCTGAAGGAGGAAATATGAAGGACAATTGGAGAAGTGAATTATATAAATATAAAGT
GGTAGAAGTTAAGCCATTAGGAGTAGCACCCACTAAGGCAAGAAGGAGAGTGGTGGAGAGAGAAAAAAGAGCAGTGG
GAATGGGAGCTGTGTTCCTTGGGTTCTTGGGAGCGGCAGGAAGCACTATGGGCGCAGCATCAATAACGCTGACGGTA
CAGGCCAGACAATTATTGTCTGGTATAGTGCAACAGCAAAGCAATTTGCTGAAGGCTATAGAGGCTCAACAGCATAT
GTTGAAACTCACGGTCTGGGGCATTAAACAGCTCCAGGCAAGAGTCCTGGCCTTGGAAAGATACCTAAAGGATCAAC
AGCTCCTAGGGATGTGGGGCTGCTCTGGAAAACTCATCTGCACCACTAATGTATATTGGAACTCTAGTTGGAGTAAT
AAAACTTATGGTGATATTTGGGATAACATGACCTGGATGCAGTGGGAGAGAGAAATTAGCAATTATACAGACATAAT
ATATGAATTGCTTGAAGAATCACAAAACCAGCAGGAAAAGAATGAACAAGATTTACTAGCATTGGACAGATGGAACA
GTCTGTGGAATTGGTTTAACATAACAAATTGGCTGTGGTATATAAAAATATTCATAATGATAGTAGGAGGCTTGATA
GGTTTAAGAATAATTTTTGCTGTGCTTTCTTTAGTAAATAGAGTTAGGCAGGGATACTCACCTCTGTCATTGCAGAC
CCTTATCCCAAGCCCGAGGGGACCAGACAGGCCCGAGGAATCGAAGAAGAAGGTGGAGAGCAAGACAGAAACAGAT
CAACGCGATTAGTGAGCGGATTCTTAGCGCTTGCCTGGGACGACCTGCGGAGCCTGTGCCTTTTCATCTACCACCGA
TTGAGAGACTTCATATTAATTGCAGCGAGAGCGGGGGAACTTCTGGGACGCAGCAGTCTCAAGGGACTACGGAGAGG
GTGGGAAGCCCTTAAGTATCTGGGAAGTCTTGTGCAGTATTGGGGCCTGGAACTAAAAAGGAGTGCTATTAGTCTAT
TGGATACCCTAGCAATAGCAGTAGGTGAAGGAACAGATAGGATTCTAGAATTTGTATTAGGAATTTGTAGAGCTATC
CGCAACATACCTACAAGAATAAGACAGGGCTTTGAAACAGCTTTGCTATAA
>703010505.W100.B3
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGCGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTAATGCTACTGCCAGCAATACCAATGCTACTGCCAGTAATATCAATGCTACTGCCAGCAAGAGCAGTATAATA
GAGGAAATGAAAAATTGCTCTTTCAATATAACCACAGAATTAAGAGATAAGAGAGAGAAAAAGTATGCACTTTTTTA
TAAACTTGATATAGTACAACTAGATGGCAACTCTAGTCAGTATAGATTAATAAATTGTAATACCTCAGTCATAACCC
AAGCCTGTCCAAAGGTCTCTTTTGACCCAATTCCTATACATTATTGTGCTCCAGCTGGTTATGCGATTCTAAAGTGT
AATAATAAGACATTCAATGGAACAGGACCGTGTAATAATGTCAGCACAGTACAATGTACACATGGAATTAAGCCAGT
GGTTTCAACTCAACTATTGTTAAATGGTAGCCTAGCAGAAGGAGATAATAATTAGATCTGAAAATATAACAGACA
ATAGCAAAACAATAATAGTACATCTCAATGAATCTGTAAAGATTGAGTGTACAAGACCCAGTAATAACACAAGAACA
AGTATAAGAATAGGACCAGGACAAGCATTTTATGCAACAGGACAAGTAATAGGAGACATAAGAGAAGCACATTGTAA
CATTAGTGAAAGTAAATGGAATGAAACTTTACAAAGGGTAAGTAAAAAATTAAAAGAATACTTCCCTGATAAGAATA
TAACATTTCAACCATCCTCAGGAGGGGACCCAGAAATTACAACACATAGCTTTAATTGTGGAGGAGAATTTTTCTAT
TGCAATACATCAAGCCTGTTTAATAGGACATACATGGCTAATAGTACAGAAACTAACAGTACACGAACCATCACACT
CCACTGCAGAATAAAACAAATTATAAACATGTGGCAGGAGGTGGGACGAGCAATGTATGCCCCTCCCATTGCAGGAA
ACATAACATGTATATCAAATATCACAGGACTACTATTGACAAGGGATGGAGGAGAAAACACAAGGGATGGAGGAAAT
AACAATACGGAGACATTCAGACCTGAAGGAGGAAATATGAAGGACAATTGGAGAAGTGAATTATATAAATATAAAGT
GGTAGAAGTTAAGCCATTAGGAGTAGCACCCACTAAGGCAAGAAGGAGAGTGGTGGAGAGAGAAAAAAGAGCAGTGG
GAATGGGAGCTGTGTTCCTTGGGTTCTTGGGAGCGGCAGGAAGCACTATGGGCGCAGCATCAATAACGCTGACGGTA
CAGGCCAGACAATTATTGTCTGGTATAGTGCAACAGCAAAGCAATTTGCTGAAGGCTATAGAGGCTCAACAGCATAT
GTTGAAACTCACGGTCTGGGGCATTAAACAGCTCCAGGCAAGAGTCCTGGCCTTGGAAAGATACCTAAAGGATCAAC
AGCTCCTAGGGATGTGGGGCTGCTCTGGAAAACTCATCTGCACCACTAATGTATATTGGAACTCTAGTTGGAGTAAT
AAAACTTATGGTGATATTTGGGATAACATGACCTGGATGCAGTGGGAGAGAGAAATTAGCAATTATACAGACATAAT
ATATGAATTGCTTGAAGAATCACAAAACCAGCAGGAAAAGAATGAACAAGATTTACTAGCATTGGACAGATGGAACA
GTCTGTGGAATTGGTTTAACATAACAAATTGGCTGTGGTATATAAAAATATTCATAATGATAGTAGGAGGCTTGATA
GGTTTAAGAATAATTTTTGCTGTGCTTTCTTTAGTAAATAGAGTTAGGCAGGGATACTCACCTCTGTCATTGCAGAC
CCTTATCCCAAGCCCGAGGGGACCAGACAGGCCCGAGGAATCGAAGAAGAAGGTGGAGAGCAAGACAGAAACAGAT
CAACGCGATTAGTGAGCGGATTCTTAGCGCTTGCCTGGGACGACCTGCGGAGCCTGTGCCTTTTCATCTACCACCGA
TTGAGAGACTTCATATTAATTGCAGCGAGAGCGGGGGAACTTCTGGGACGCAGCAGTCTCAAGGGACTACGGAGAGG
GTGGGAAGCCCTTAAGTATCTGGGAAGTCTTGTGCAGTATTGGGGCCTGGAACTAAAAAGGAGTGCTATTAGTCTAT
```

FIG. 17B cont'd

```
TGGATACCCTAGCAATAGCAGTAGGTGAAGGAACAGATAGGATTCTAGAATTTGTATTAGGAATTTGTAGAGCTATC
CGCAACATACCTACAAGAATAAGACAGGGCTTTGAAACAGCTTTGCTATAA
>703010505.W100.A5
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGCGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTAATGCTACTGCCAGCAATACCAATGCTACTGCCAGCAATATCAATGCTACTGCCAGCAAGAGCAGTATAATA
GAGGAAATGAAAAATTGCTCTTTCAATATAACCACAGAATTAAGAGATAAGAGAGAGAAAAAGTATGCACTTTTTTA
TAAACTTGATATAGTACAACTAGATGGCAACTCTAGTCAGTATAGATTAATAAATTGTAATACCTCAGTCATAACCC
AAGCCTGTCCAAAGGTCTCTTTTGACCCAATTCCTATACATTATTGTGCTCCAGCTGGTTATGCGATTCTAAAGTGT
AATAATAAGACATTCAATGGAACAGGACCGTGTAATAATGTCAGCACAGTACAATGTACACATGGAATTAAGCCAGT
GGTTTCAACTCAACTATTGTTAAATGGTAGCCTAGCAGAAGGAGAGATAATAATTAGATCTGAAAATATAACAGACA
ATAGCAAAACAATAATAGTACATCTCAATGAATCTGTAAAGATTGAGTGTACAAGACCCAGTAATAACACAAGAACA
AGTATAAGAATAGGACCAGGACAAGCATTTTATGCAACAGGACAAGTAATAGGAGACATAAGAGAAGCACATTGTAA
CATTAGTGAAAGTAAATGGAATGAAACTTTACAAAGGGTAAGTAAAAAATTAAAAGAATACTTCCCTGATAAGAATA
TAACATTTCAACCATCCTCAGGAGGGGACCCAGAAATTACAACACATAGCTTTAATTGTGGAGGAGAATTTTTCTAT
TGCAATACATCAAGCCTGTTTAATAGGACATACATGGCTAATAGTACAGAAACTAACAGTACACGAACCATCACACT
CCACTGCAGAATAAAACAAATTATAAACATGTGGCAGGAGGTGGGACGAGCAATGTATGCCCCTCCCATTGCAGGAA
ACATAACATGTATATCAAATATCACAGGACTACTATTGACAAGGGATGGAGGAGAAAACACAAGGGATGGAGGAAAT
AACAATACGGAGACATTCAGACCTGAAGGAGGAAATATGAAGGACAATTGGAGAAGTGAATTATATAAATATAAAGT
GGTAGAAGTTAAGCCATTAGGAGTAGCACCCACTAAGGCAAGAAGGAGAGTGGTGGAGAGAGAAAAAAGAGCAGTGG
GAATGGGAGCTGTGTTCCTTGGGTTCTTGGGAGCGGCAGGAAGCACTATGGGCGCAGCATCAATAACGCTGACGGTA
CAGGCCAGACAATTATTGTCTGGTATAGTGCAACAGCAAAGCAATTTGCTGAAGGCTATAGAGGCTCAACAGCATAT
GTTGAAACTCACGGTCTGGGGCATTAAACAGCTCCAGGCAAGAGTCCTGGCCTTGGAAAGATACCTAAAGGATCAAC
AGCTCCTAGGGATGTGGGGCTGCTCTGGAAAACTCATCTGCACCACTAATGTATATTGGAACTCTAGTTGGAGTAAT
AAAAACTTATGGTGATATTTGGGATAACATGACCTGGATGCAGTGGGAGAGAGAAATTAGCAATTATACAGACATAAT
ATATGAATTGCTTGAAGAATCACAAAACCAGCAGGAAAAGAATGAACAAGATTTACTAGCATTGGACAGATGGAACA
GTCTGTGGAATTGGTTTAACATAACAAATTGGCTGTGGTATATAAAAATATTCATAATGATAGTAGGAGGCTTGTATA
GGTTTAAGAATAATTTTTGCTGTGCTTTCTTTAGTAAATAGAGTTAGGCAGGGATACTCACCTCTGTCATTGCAGAC
CCTTATCCCAAGCCCGAGGGGACCAGACAGGCCCGGAGGAATCGAAGAAGAAGGTGGAGAGCAAGACAGAAACAGAT
CAACGCGATTAGTGAGCGGATTCTTAGCGCTTGCCTGGGACGACCTGCGGAGCCTGTGCCTTTTCATCTACCACCGA
TTGAGAGACTTCATATTAATTGCAGCGAGAGCGGGGGAACTTCTGGGACGCAGCAGTCTCAAGGGACTACGGAGAGG
GTGGGAAGCCCTTAAGTATCTGGGAAGTCTTGTGCAGTATTGGGGCCTGGAACTAAAAAGGAGTGCTATTAGTCTAT
TGGATACCCTAGCAATAGCAGTAGGTGAAGGAACAGATAGGATTCTAGAATTTGTATTAGGAATTTGTAGAGCTATC
CGCAACATACCTACAAGAATAAGACAGGGCTTTGAAACAGCTTTGCTATAA
>703010505.W100.A3
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGCGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTAATGCTACTGCCAGCAATACCAATGCTACTGCCAGCAATATCAATGCTACTGCCAGCAAGAGCAGTATAATA
GAGGAAATGAAAAATTGCTCTTTCAATATAACCACAGAATTAAGAGATAAGAGAGAGAAAAAGTATGCACTTTTTTA
TAAACTTGATATAGTACAACTAGATGGCAACTCTAGTCAGTATAGATTAATAAATTGTAATACCTCAGTCATAACCC
AAGCCTGTCCAAAGGTCTCTTTTGACCCAATTCCTATACATTATTGTGCTCCAGCTGGTTATGCGATTCTAAAGTGT
AATAATAAGACATTCAATGGAACAGGACCGTGTAATAATGTCAGCACAGTACAATGTACACATGGAATTAAGCCAGT
GGTTTCAACTCAACTATTGTTAAATGGTAGCCTAGCAGAAGGAGAGATAATAATTAGATCTGAAAATATAACAGACA
ATAGCAAAACAATAATAGTACATCTCAATGAATCTGTAAAGATTGAGTGTACAAGACCCAGTAATAACACAAGAACA
AGTATAAGAATAGGACCAGGACAAGCATTTTATGCAACAGGACAAGTAATAGGAGACATAAGAGAAGCACATTGTAA
CATTAGTGAAAGTAAATGGAATGAAACTTTACAAAGGGTAAGTAAAAAATTAAAAGAATACTTCCCTGATAAGAATA
TAACATTTCAACCATCCTCAGGAGGGGACCCAGAAATTACAACACATAGCTTTAATTGTGGAGGAGAATTTTTCTAT
TGCAATACATCAAGCCTGTTTAATAGGACATACATGGCTAATAGTACAGAAACTAACAGTACACGAACCATCACACT
CCACTGCAGAATAAAACAAATTATAAACATGTGGCAGGAGGTGGGACGAGCAATGTATGCCCCTCCCATTGCAGGAA
ACATAACATGTATATCAAATATCACAGGACTACTATTGACAAGGGATGGAGGAGAAAACACAAGGGATGGAGGAAAT
AACAATACGGAGACATTCAGACCTGAAGGAGGAAATATGAAGGACAATTGGAGAAGTGAATTATATAAATATAAAGT
GGTAGAAGTTAAGCCATTAGGAGTAGCACCCACTAAGGCAAGAAGGAGAGTGGTGGAGAGAGAAAAAAGAGCAGTGG
GAATGGGAGCTGTGTTCCTTGGGTTCTTGGGAGCGGCAGGAAGCACTATGGGCGCAGCATCAATAACGCTGACGGTA
CAGGCCAGACAATTATTGTCTGGTATAGTGCAACAGCAAAGCAATTTGCTGAAGGCTATAGAGGCTCAACAGCATAT
GTTGAAACTCACGGTCTGGGGCATTAAACAGCTCCAGGCAAGAGTCCTGGCCTTGGAAAGATACCTAAAGGATCAAC
AGCTCCTAGGGATGTGGGGCTGCTCTGGAAAACTCATCTGCACCACTAATGTATATTGGAACTCTAGTTGGAGTAAT
AAAAACTTATGGTGATATTTGGGATAACATGACCTGGATGCAGTGGGAGAGAGAAATTAGCAATTATACAGACATAAT
ATATGAATTGCTTGAAGAATCACAAAACCAGCAGGAAAAGAATGAACAAGATTTACTAGCATTGGACAGATGGAACA
GTCTGTGGAATTGGTTTAACATAACAAATTGGCTGTGGTATATAAAAATATTCATAATGATAGTAGGAGGCTTGATA
GGTTTAAGAATAATTTTTGCTGTGCTTTCTTTAGTAAATAGAGTTAGGCAGGGATACTCACCTCTGTCATTGCAGAC
CCTTATCCCAAGCCCGAGGGGACCAGACAGGCCCGGAAGAATCGAAGAAGAAGGTGGAGAGCAAGACAGAAACAGAT
CAACGCGATTAGTGAGCGGATTCTTAGCGCTTGCCTGGGACGACCTGCGGAGCCTGTGCCTTTTCATCTACCACCGA
TTGAGAGACTTCATATTAATTGCAGCGAGAGCGGGGGAACTTCTGGGACGCAGCAGTCTCAAGGGACTACGGAGAGG
GTGGGAAGCCCTTAAGTATCTGGGAAGTCTTGTGCAGTATTGGGGCCTGGAACTAAAAAGGAGTGCTATTAGTCTAT
```

FIG. 17B cont'd

```
TGGATACCCTAGCAATAGCAGTAGGTGAAGGAACAGATAGGATTCTAGAATTTGTATTAGGAATTTGTAGAGCTATC
CGCAACATACCTACAAGAATAAGACAGGGCTTTGAAACAGCTTTGCTATAA
>703010505.W100.C4
ATGAGAGTGATGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGCGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTAATGCTACTGCCAGCAATACCAATGCTACTGCCAGCAATATCAATGCTACTGCCAGCAAGAGCAGTATAATA
GAGGAAATGAAAAATTGCTCTTTCAATATAACCACAGAATTAAGAGATAAGAGAGAGAAAAAGTATGCACTTTTTTA
TAAACTTGATATAGTACAACTAGATGGCAACTCTAGTCAGTATAGATTAATAAATTGTAATACCTCAGTCATAACCC
AAGCCTGTCCAAAGGTCTCTTTTGACCCAATTCCTATACATTATTGTGCTCCAGCTGGTTATGCGATTCTAAAGTGT
AATAATAAGACATTCAATGGAACAGGACCGTGTAATAATGTCAGCACAGTACAATGTACACATGGAATTAAGCCAGT
GGTTTCAACTCAACTATTGTTAAATGGTAGCCTAGCAGAAGGAGAGATAATAATTAGATCTGAAAATATAACAGACA
ATAGCAAAACAATAATAGTACATCTCAATGAATCTGTAAAGATTGAGTGTACAAGACCCAGTAATAACACAAGAACA
AGTATAAGAATAGGACCAGGACAAGCATTTTATGCAACAGGACAAGTAATAGGAGACATAAGAGAAGCACATTGTAA
CATTAGTGAAAGTAAATGGAATGAAACTTTACAAAGGGTAAGTAAAAAATTAAAAGAATACTTCCCTGATAAGAATA
TAACATTTCAACCATCCTCAGGAGGGGACCCAGAAATTACAACACATAGCTTTAATTGTGGAGGAGAATTTTTCTAT
TGCAATACATCAAGCCTGTTTAATAGGACATACATGGCTAATAGTACAGAAACTAACAGTACACGAACCATCACACT
CCACTGCAGAATAAAACAAATTATAAACATGTGGCAGGAGGTGGGACGAGCAATGTATGCCCCTCCCATTGCAGGAA
ACATAACATGTATATCAAATATCACAGGACTACTATTGACAAGGGATGGAGGAGAAAACACAAGGGATGGAGGAAAT
AACAATACGGAGACATTCAGACCTGAAGGAGGAAATATGAAGGACAATTGGAGAAGTGAATTATATAAATATAAAGT
GGTAGAAGTTAAGCCATTAGGAGTAGCACCCACTAAGGCAAGAAGGAGAGTGGTGGAGAGAGAAAAAAGAGCAGTGG
GAATGGGAGCTGTGTTCCTTGGGTTCTTGGGAGCGGCAGGAAGCACTATGGGCGCAGCATCAATAACGCTGACGGTA
CAGGCCAGACAATTATTGTCTGGTATAGTGCAACAGCAAAGCAATTTGCTGAAGGCTATAGAGGCTCAACAGCATAT
GTTGAAACTCACGGTCTGGGGCATTAAACAGCTCCAGGCAAGAGTCCTGGCCTTGGAAAGATACCTAAAGGATCAAC
AGCTCCTAGGGATGTGGGGCTGCTCTGGAAAACTCATCTGCACCACTAATGTATATTGGAACTCTAGTTGGAGTAAT
AAAACTTATGGTGATATTTGGGATAACATGACCTGGATGCAGTGGGAGAGAGAAATTAGCAATTATACAGACATAAT
ATATGAATTGCTTGAAGAATCACAAAACCAGCAGGAAAAGAATGAACAAGATTTACTAGCATTGGACAGATGGAACA
GTCTGTGGAATTGGTTTAACATAACAAATTGGCTGTGGTATATAAAAATATTCATAATGATAGTAGGAGGCTTGATA
GGTTTAAGAATAATTTTTGCTGTGCTTTCTTTAGTAAATAGAGTTAGGCAGGGATACTCACCTCTGTCATTGCAGAC
CCTTATCCCAAGCCCGAGGGGACCAGACAGGCCCGAGGAATCGAAGAAGAAGGTGGAGAGCAAGACAGAAACAGAT
CAACGCGATTAGTGAGCGGATTCTTAGCGCTTGCCTGGGACGACCTGCGGAGCCTGTGCCTTTTCATCTACCACCGA
TTGAGAGACTTCATATTAATTGCAGCGAGAGCGGGGGAACTTCTGGGACGCAGCAGTCTCAAGGGACTACGGAGAGG
GTGGGAAGCCCTTAAGTATCTGGAAAGTCTTGTGCAGTATTGGGGCCTGGAACTAAAAAGGAGTGCTATTAGTCTAT
TGGATACCCTAGCAATAGCAGTAGGTGAAGGAACAGATAGGATTCTAGAATTTGTATTAGGAATTTGTAGAGCTATC
CGCAACATACCTACAAGAATAAGACAGGGCTTTGAAACAGCTTTGCTATAA
>703010505.W100.B6
ATGAAAGTGAGGGGGGATACAGAGGAATTATCCACAATGGTGGATATGGAGCATGTTAGGCTTGTGGATGCTAATGAT
TTGTAATGGGATGTGGGTCACAGTCTATTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAGAAAAATGTAACAGAAAATTTCAACATGTGGAAAAATGACATGGCGGATCAGATGCATGAAGA
TGTAATTAGTTTATGGGATCAAAGCCCTCAAGCCATGTGTAAAGTTGACCCCACTCTGTGTCACTCTAAACTGTACCG
ATGCTAATGCTACTGCCAGCAATACCAATGCTACTGCCAGCAATATCAATGCTACTGCCAGCAAGAGCAGTATAATA
GAGGAAATGAAAAATTGCTCTTTCAATATAACCACAGAATTAAGAGATAAGAGAGAGAAAAAGTATGCACTTTTTTA
TAAACTTGATATAGTACAACTAGATGGCAACTCTAGTCAGTATAGATTAATAAATTGTAATACCTCAGTCATAACCC
AAGCCTGTCCAAAGGTCTCTTTTGACCCAATTCCTATACATTATTGTGCTCCAGCTGGTTATGCGATTCTAAAGTGT
AATAATAAGACATTCAATGGAACAGGACCGTGTAATAATGTCAGCACAGTACAATGTACACATGGAATTAAGCCAGT
GGTTTCAACTCAACTATTGTTAAATGGTAGCCTAGCAGAAGGAGAGATAATAATTAGATCTGAAAATATAACAGACA
ATAGCAAAACAATAATAGTACATCTCAATGAATCTGTAAAGATTGAGTGTACAAGACCCAGTAATAACACAAGAACA
AGTATAAGGATAGGACCAGGACAAGCATTTTATGCAACAGGACAAGTAATAGGAGACATAAGAGAAGCACATTGTAA
CATTAGTGAAAGTAAATGGAATGAAACTTTACAAAGGGTAAGTAAAAAATTAAAAGAATACTTCCCTGATAAGAATA
TAACATTTCAACCATCCTCAGGAGGGGACCCAGAAATTACAACACATAGCTTTAATTGTGGAGGAGAATTTTTCTAT
TGCAATACATCAAGCCTGTTTAATAGGACATACATGGCTAATAGTACAGAAACTAACAGTACACGAACCATCACACT
CCACTGCAGAATAAAACAAATTATAAACATGTGGCAGGAGGTGGGACGAGCAATGTATGCCCCTCCCATTGCAGGGA
ACATAACATGTATATCAAATATCACAGGACTACTATTGACAAGGGATGGAGGAGAAAACACAAGGGATGGAGGAAAT
AACAATACGGAGACATTCAGACCTGAAGGAGGAAATATGAAGGACAATTGGAGAAGTGAATTATATAAATATAAAGT
GGTAGAAGTTAAGCCATTAGGAGTAGCACCCACTAAGGCAAGAAGGAGAGTGGTGGAGAGAGAAAAAAGAGCAGTGG
GAATGGGAGCTGTGTTCCTTGGGTTCTTGGGAGCGGCAGGAAGCACTATGGGCGCAGCATCAATAACGCTGACGGTA
CAGGCCAGACAATTATTGTCTGGTATAGTGCAACAGCAAAGCAATTTGCTGAAGGCTATAGAGGCTCAACAGCATAT
GTTGAAACTCACGGTCTGGGGCATTAAACAGCTCCAGGCAAGAGTCCTGGCCTTGGAAAGATACCTAAAGGATCAAC
AGCTCCTAGGGATGTGGGGCTGCTCTGGAAAACTCATCTGCACCACTAATGTATATTGGAACTCTAGTTGGAGTAAT
AAAACTTATGGTGATATTTGGGATAACATGACCTGGATGCAGTGGGAGAGAGAAATTAGCAATTATACAGACATAAT
ATATGACTTGCTTGAAGAATCACAAAACCAGCAGGAAAAGAATGAACAAGATTTACTAGCATTGGACAGATGGAACA
GTCTGTGGAATTGGTTTAACATAACAAATGGCTGTGGTATATAAAAATATTCATAATGATAGTAGGAGGCTTGATA
GGTTTAAGAATAATTTTTGCTGTGCTTTCTTTAGTAAATAGAGTTAGGCAGGGATACTCACCTCTGTCGTTACAGAC
CCTTATCCCAAGCCCGAGGGGACCAGACAGGCCCGAGGAATCGAAGAAGAAGGTGGAGAGCAAGACAGAAACAGAT
CAACGCGATTAGTGAGCGGATTCTTAGCGCTTGCCTGGGACGACCTGCGGAGCCTGTGCCTTTTCATCTACCACCGA
TTGAGAGACTTCATATTAATTGCAGCGAGAGCGGGGGAACTTCTGGGACGCAGCAGTCTCAAGGGACTACGGAGAGG
GTGGGAAGCCCTTAAGTATCTGGGAGGTCTTGTGCAGTATTGGGGCCTGGAACTAAAAAGGAGTGCTATTAGTCTAT
```

FIG. 17B cont'd

```
TGGATACCCTAGCAATAGCAGTAGGTGAAGGAACAGATAGGATTCTAGAATTTGTATTAGGAATTTGTAGAGCTATC
CGCAACATACCTACAAGAATAAGACAGGGCTTTGAAACAGCTTTGCTATAA
>793010505.W100.A13
ATGAGAGTGATGGGGATACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGCGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGCGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTAATGCTACTGCCAGCAATGCTAATGCTACTGCCAGCAATACCAATGCTACTGTCAGCAATAGCAGTATAATA
GAGGAAATGAAAAATTGCTCTTTCAATATAACCACAGAATTAAGAGATAAGAGAGAGAAAAAGTATGCACTTTTTTA
TAAACTTGATATAGTACAACTAGATGGCAACTCTAGTCAGTATAGATTAATAAATTGTAATACCCTCAGTCATAACCC
AAGCCTGTCCAAAGGTCTCTTTTGACCCAATTCCTATACATTATTGTGCTCCAGCTGGTTATGCGATTCTAAAGTGT
AATAATAAGACATTCAATGGAACAGGACCGTGTAATAATGTCAGCACAGTACAATGTACACATGGAATTAAGCCAGT
GGTTTCAACTCAACTACTGTTAAATGGTAGCCTAGCAGAAGGAGAGATAATAATTAGATCTGAAAATATAACAAACA
GTGCCAAAACAATAATAGTACATCTCAATGAATCTGTAAAGATTGAGTGTACGAGACCCAGTAATAACACAAGAACA
AGTATAAGAATAGGACCAGGACAAGCATTTTATGCAACAGGACAAGTAATAGGAGACATAAGAAAAGCACATTGTAA
CATTAGTGAAAGTAAATGGAATGAAACTTTACAAAGGGTAAGTAAAAAATTAAAAGAATACTTCCCTCATAAGAATA
TAACATTTCAACCATCCTCAGGAGGGGACCCAGAAATTACAACGCATAGTTTTAATTGTGGAGGAGAATTTTTCTAT
TGCAATACATCAAGCCTGTTTAATAGGACATACATGGCTAATAGTACAGAAACTAACAGTACACGAACCATCACACT
CCACTGCAGAATAAAACAAATTATAAACATGTGGCAGGAGGTGGGACGAGCAATGTATGCCCCTCCCATTGCAGGAA
ACATAACATGTATATCAAATATCACAGGACTACTATTGACAAGGGATGGGGGAGAAAACACAAGGGATGGAGGAAAT
AACAATACGGAGACATTCAGACCTGGAGGAGGAAATATGAAGGACAATTGGAGAAGTGAATTATATAAATATAAAGT
GGTAGAAGTTAAGCCATTAGGAGTAGCACCCACTAATGCAAGAAGGAGAGTGGTGGAGAGAGAAAAAGAGCAGTGG
GAATGGGAGCTGTGTTCCTTGGGTTCTTGGGAGCGGCAGGAAGCACTATGGGCGCAGCATCAATAACGCTGACGGTA
CAGGCCAGACAATTATTGTCTGGTATAGTGCAACAGCAAAGCAATTTGCTGAAGGCTATAGAGGCTCAACAGCATAT
GTTGAAACTCACGGTCTGGGGCATCAAACAGCTCCAGGCAAGAGTCCTGGCCTTGGAAAGATACCTAAAGGATCAAC
AGCTCCTAGGGATGTGGGGCTGCTCTGGAAAACTCATCTGCACCACTAATGTATATTGGAACTCTAGTTGGAGTAAT
AAAACTTATGGTGATATTTGGGATAACATGACCTGGATGCAGTGGGAGAGAGAAATTAGCAATTATACAGACATAAT
ATATGACTTGCTTGAAGAATCACAAAACCAGCAGGAAAAGAATGAACAAGATTTACTAGCATTGGACAGATGGAACA
GTCTGTGGAATTGGTTTAACATAACAAAATGGCTGTGGTATATAAAAATATTCATAATGATAGTAGGAGGCTTGATA
GGTTTAAGAATAATTTTGCTGTGCTTTCTTTAGTAAATAGAGTTAGGCAGGGATACTCACCTCTGTCGTTGCAGAC
CCTTATCCCAAGCCCGAGGGGACCAGACAGGCCCGGAGGAATCGAAGAAGAAGGTGGAGAGCAAGACAGAAACAGAT
CAACGCGATTAGTGAGCGGATTCTTAGCGCTTGCCTGGGACGACCTGCGGAGCCTGTGCCTTTTCATCTACCACCGA
TTGAGAGACTTCATATTAATTGCAGCGAGAGCGGGGGAACTTCTGGACGCAGCAGTCTCAAGGGACTACGGAGAGG
ATGGGAAGCCCTTAAGTATCTGGGAGGTCTTGTGCAGTATTGGGGCCTGGAACTAAAAAGGAGTGCTATTAGTCTAT
TGGATACCCTAGCAATAGCAGTAGGTGAAGGAACAGATAGGATTCTAGAATTTGTATTAGGAATTTGTAGAGCTATC
CGCAACATACCTACAAGAATAAGACAGGGCTTTGAAACAGCTTTGCTATAA
>793010505.W100.B9
ATGAGAGTGATGGGGATACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGCGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGCGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTAATGCTACTGCCAGCAATGCTAATGCTACTGCCAGCAATACCAATGCTACTGTCAGCAATAGCAGTATAATA
GAGGAAATGAAAAATTGCTCTTTCAATATAACCACAGAATTAAGAGATAAGAGAGAGAAAAAGTATGCACTTTTTTA
TAAACTTGATATAGTACAACTAGATGGCAACTCTAGTCAGTATAGATTAATAAATTGTAATACCCTCAGTCATAACCC
AAGCCTGTCCAAAGGTCTCTTTTGACCCAATTCCTATACATTATTGTGCTCCAGCTGGTTATGCGATTCTAAAGTGT
AATAATAAGACATTCAATGGAACAGGACCGTGTAATAATGTCAGCACAGTACAATGTACACATGGAATTAAGCCAGT
GGTTTCAACTCAACTATTGTTAAATGGTAGCCTAGCAGAAGGAGAGATAATAATTAGATCTGAAAATATAACAAACA
GTGCCAAAACAATAATAGTACATCTCAATGAATCTGTAAAGATTGAGTGTACGAGACCCAGTAATAACACAAGAACA
AGTATAAGAATAGGACCAGGACAAGCATTTTATGCAACAGGACAAGTAATAGGAGACATAAGAAAAGCACATTGTAA
CATTAGTGAAAGTAAATGGAATGAAACTTTACAAAGGGTAAGTAAAAAATTAAAAGAATACTTCCCTCATAAGAATA
TAACATTTCAACCATCCTCAGGAGGGGACCCAGAAATTACAACACATAGTTTTAATTGTGGAGGAGAATTTTTCTAT
TGCAATACATCAAGCCTGTTTAATAGGACATACATGGCTAATAGTACAGAAACTAACAGTACACGAACCATCACACT
CCACTGCAGAATAAAACAAATTATAAACATGTGGCAGGAGGTGGGACGAGCAATGTATGCCCCTCCCATTGCAGGAA
ACATAACATGTATATCAAATATCACAGGACTACTATTGACAAGGGATGGGGGAGAAAACACAAGGGATGGAGGAAAT
AACAATACGGAGACATTCAGACCTGGAGGAGGAAATATGAAGGACAATTGGAGAAGTGAATTATATAAATATAAAGT
GGTAGAAGTTAAGCCATTAGGAGTAGCACCCACTAAGGCAAGAAGGAGAGTGGTGGAGAGAGAAAAAAGAGCAGTGG
GAATGGGAGCTGTGTTCCTTGGGTTCTTGGGAGCGGCAGGAAGCACTATGGGCGCAGCATCAATAACGCTGACGGTA
CAGGCCAGACAATTATTGTCTGGTATAGTGCAACAGCAAAGCAATTTGCTGAAGGCTATAGAGGCTCAACAGCATAT
GTTGAAACTCACGGTCTGGGGCATTAAACAGCTCCAGGCAAGAGTCCTGGCCTTGGAAAGATACCTAAAGGATCAAC
AGCTCCTAGGGATGTGGGGCTGCTCTGGAAAACTCATCTGCACCACTAATGTATATTGGAACTCTAGTTGGAGTAAT
AAAACTTATGGTGATATTTGGGATAACATGACCTGGATGCAGTGGGAGAGAGAAATTAGCAATTATACAGACATAAT
ATATGACTTGCTTGAAGAATCACAAAACCAGCAGGAAAAGAATGAACAAGATTTACTAGCATTGGACAGATGGAACA
GTCTGTGGAATTGGTTTAACATAACAAATGGCTGTGGTATATAAAAATATTCATAATGATAGTAGGAGGCTTGATA
GGTTTAAGAATAATTTTTGCTGTGCTTTCTTTAGTAAATAGAGTTAGGCAGGGATACTCACCTCTGTCATTGCAGAC
CCTTATCCCAAGCCCGAGGGGACCAGACAGGCCCGGAGGAATCGAAGAAGAAGGTGGAGAGCAAGACAGAAACAGAT
CAACGCGATTAGTGAGCGGATTCTTAGCGCTTGCCTGGGACGACCTGCGGAGCCTGTGCCTTTTCATCTACCACCGA
TTGAGAGACTTCATATTAATTGCAGCGAGAGCGGGGGAACTTCTGGACGCAGCAGTCTCAAGGGACTACGGAGAGG
ATGGGAAGCCCTTAAGTATCTGGGAGGTCTTGTGCAGTATTGGGGCCTGGAACTAAAAAAGAGTGCTATTAGTTTAT
```

FIG. 17B cont'd

```
TGGATACCCTAGCAATAGCAGTAGGTGAAGGAACAGATAGGATTCTAGAATTTGTATTAGGAATTTGTAGAGCTATC
CGCAACATACCTACAAGAATAAGACAGGGCTTTGAAACAGCTTTGCTATAA
>703010505.W100.T1
ATGAGAGTGATGGGGATACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGCGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTAATGCTACTGCCAGCAATACCAATGCTACTGCCAGCAATATCAATGCTACTGCCAGCAAGAGCAGTATAATA
GAGGAAATGAAAAATTGCTCTTTCAATATAACCACAGAATTAAGAGATAAGAGAGAGAAAAAATATGCACTTTTTA
TAAACTTGATATAGTACAACTAGATGGCAACTCTAGTCAGTATAGATTAATAAATTGTAATACCTCAGTCATAACCC
AAGCCTGTCCAAAGGTCTCTTTTGACCCAATTCCTATACATTATTGTGCTCCAGCTGGTTATGCGATTCTAAAGTGT
AATAATAAGACATTCAATAGAACAGGACCGTGTAATAATGTCAGCACAGTACAATGTACACATGGAATTAAGCCAGT
GGTTTCAACTCAACTATTGTTAAATGGTAGCCTAGCAGAAGGAGAGATAATAATTAGATCTGAAAATATAACAGACA
ATGGCAAAACAATAATAGTACATCTCAATGAATCTGTAAAGATTGAATGTACGAGACCCAGTAATAACACAAGAACA
AGTATAAGAATAGGACCAGGACAAGCATTTTATGCAACAGGACAAGTAATAGGAGACATAAGAGAAGCACATTGTAA
CATTAGTGAAAGTAAATGGAATGAAACTTTACAAAGGGTAAGTAAAAAATTAAAAGAATACTTCCCTGATAAGAATA
TAACATTTCAATCATCCTCAGGAGGGGACCCAGAAATTACAACACATAGCTTTAATTGTGGAGGAGAATTTTTCTAT
TGCAATACATCAAGCCTGTTTAATAGGACATACATGGCTAATAGTACAGAAACTAACAGTACACGAACCATCACACT
CCACTGCAGAATAAAACAAATTATAAACATGTGGCAGGAGGTGGGAGCAATGTATGCCCCTCCCATTGCAGGAA
ACATAACATGTATATCAAATATCACAGGACTACTATTGACAAGGGACGGAGGAAACGATACGGATACGGAGACATTC
AGACCTGGAGGAGGAAATATGAAGGACAATTGGAGAAGTGAATTATATAAATATAAAGTGGTAGAAGTTAAGCCATT
AGGAGTAGCACCCACTAATGCAAGAAGGAGAGTGGTGGAGAGAGAAAAAGAGCAGTGGGAATGGGAGCTGTGTTCC
TTGGGTTCTTGGGAGCGGCAGGAAGCACTATGGGCGCAGCATCAATAACGCTGACGGTACAGGCCAGACAATTATTG
TCTGGTATAGTGCAACAGCAAAGCAATTTGCTGAAGGCTCAACAGCATATGTTGAAACTCACGGTCTG
GGGCATTAAACAGCTCCAGGCAAGAGTCCTGGCCTTGGAAAGATACCTAAAGAATCAACAGCTCCTAGGGATGTGGG
GCTGCTCTGGAAAACTCATCTGCACCACTAATGTATATTGGAACTCTAGTTGGAGTAATAAAACTTATGGTGATATT
TGGGATAACATGACCTGGATGCAGTGGGAGAGAGAAATTAGCAATTATACAGAAATAATATATGACTTGCTTGAAGA
ATCACAAAACCAGCAGGAAAAGAATGAACAAGATTTACTAGCATTGGACAGATGGAACAGTCTGTGGAATTGGTTTA
ACATAACAAATGGCTGTGTATATAAAAATATTCATAATGATAGTAGGAGGCTTGATAGGTTTAAGAATAATTTTT
GCTGTGCTTTCTTTAGTAAATAGAGTTAGGCAGGGATACTCACCTCTGTCGTTGCAGACCCTTATCCCAAGCCCGAG
GGGACCAGACAGGCCCGGAGGAATCGAAGAAGAAGGTGGAGAGCAAGCACAGAAACAGATCAACGCGATTAGTGAGCG
GATTCTTAGCGCTTGCCTGGGACGACCTGCGGAGCCTGTGCCTTTTCATCTACCACCGATTGAGAGACTTCATATTA
ATTGCAGCGAGAGCGGGAGAACTTCTGGGACGCAGCAGTCTCAAGAGACTACGGAGGGGATGGAAAGCCCTTAAGTA
TCTGGGAGGTCTTGTGCAGTATTGGGGCCTGGAACTAAAAAGGAGTGCTATTAGTCTATTGGATACCCTAGCAATAG
CAGTAGGTGAAGGAACAGATAGGATTCTAGAATTTGTATTAGGAATTTGTAGAGCTATCCGCAACATACCTACAAGA
ATAAGACAGGGCTTTGAAACAGCTTTGCTATAA
>703010505.W136.B1
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAAGGTTTTAAAAAATGTAACAGATGCTAAAGCATATGAGAAAGAAGTGCATAATGTCTGGGCTACACATGC
CTGTGTACCCACAGACCCCAATCCACAAGAAAGGTTTTAAAAAATGTAACAGAAAATTTCAACATGTGGAAAATG
ACATGGTGGATCAGATGCATGAAGATGTAATTAGTTTATGGGATCAAAGCCTCAAGCCATGTGTAAAGTTGACCCCA
CTCTGTGTCACTCTAAACTGTATCAATGCTACTAATGCTACTGACAGCAATAGCAATATATTAGAGGGAATGAAAAA
TTGCTCTTTCAATATAACCACAGAATTAAGAGATAAGAGAAGAAAGAATGCACTTTTTTTATAAACTTGATATAG
TACAACTAGGTGGCAACTCTAGTCAGTATAGATTAATAAATTGTAATACCTCAGTCATAACACAAGCCTGTCCAAAG
GTCTCTTTTGACCCAATTCCTATACATTATTGTGCTCCAGCTGGTTATGCGATTCTAAAGTGTAATAATAAGACATT
CAATGGAACAGGACCGTGTAATAATGTCAGCACAGTACAATGTACACATGGAATTAAGCCAGTGGTTTCAACTCAAC
TATTGTTAAATGGTAGCCTAGCAGAAGGAGAGATAATAATTAGATCTAAAAATATAACAGACAATAGCAAAACAATA
ATAGTACATCTCAATGAATCTGTAAAGATTGAGTGTACAGACCCAGTAATAACACAAGAACASTATAAGAATAGG
ACCAGGACAAGCATTTTATGCAACAGGACAAGTAATAGGAAATATAAGAGAAGCACATTGTAACATTAGTGAAAGTA
AATGGAATGAGACTTTACAAAGGGTAAGTGAAAAATTAAAAAAAATACTTCCCTGATAAGAATATAACATTTCGACCA
TCCTCAGGAGGGGACCTAGAAATTACAACACATAGCTTTAATTGTGGAGGAGAATTTTTCTATTGCAATACATCAAG
CCTGTTTAATAGGACATATATGGCTACTAGTACAGATATGGCTAATAGTACAGAAACTAACAGTACACGAATCATCA
CAATCCACTGCAGAATAAAACAAATTATAAACATGTGGCAGGGGAGGTGGGCAGCAATGTATGCCCCTCCCATTGCA
GGAAACATAACATGTATATCAAATATCACAGGACTACTATTGACAAGGGATGGAGGAAACAATACCAGGGATACGGA
GACATTCAGACCTGAAGGAGGAAATATGAAGGACAATTGGAGAAGTGAATTATATAAATATAAAGTGGTAGAAGTTA
AGCCATTAGGAGTAGCACCCACTAATGCAAGAAGGAGAGTGGTGGAGAGAGAAAAAGAGCAGTGGGAATGGGAGCT
GTGTTCCTTGGGTTCTTGGGAGCGGCAGGAAGCACTATGGGCGCAGCATCAATAACGCTGACGGTACAGGCCAGACA
ATTATTGTCTGGTATAGTGCAACAGCAAAGCAATTTGCTGAAGGCTATAGAGGCTCAACAGCATATGTTGAAACTCA
CGGTCTGGGGCATTAAACAGCTCCAGGCAAGAGTCCTGGCCTTGGAAAGATACCTAAAGGATCAACAGCTCCTAGGG
ATGTGGGGCTGCTCTGGAAAACTCATCTGCACCACTAATGTATATTGGAACTCTAGTGGAGTAATAAAACTTATGA
TGATATTTGGGATAACATGACCTGGATGCAGTGGGAGAGAGAAATTGGCAATTATACAAACATAATATATGAATTGC
TTGAAGAATCACAAAACCAGCAGGAAAAGAATGAACAAGATTTACTAGCATTGGACAGATGGAACAGTCTGTGGAAT
TGGTTTAACATAACAAATTGGCTGTGGTATATAAAAATATTCATAATGATAGTAGGAGGCTTGATAGGTTTAAGAAT
AATTTTTGCTGTGCTTTCTTTAGTAAATAGAGTTAGGCAGGGATACTCACCTCTGTCATTGCAGACCCTTATCCCAA
GCCCGAGGGGACCCGACAGGCCCGGAGGAATCGAAGAAGAAGGTGGAGAGCAAGACAGAGACAGATCAACGCGATTA
GTGAGCGGATTCTTAGCGCTTGCCTGGGACGACCTGCGGAGCCTGTGCCTTTTCATCTACCACCGATTGAGAGACTT
CATATTAATTGCAGCGAGAGCGGGGGAACTTCTGGGACGCAGCAGTCTCAAGGGACTACGGAGAGGGTGGGAAGCCC
```

FIG. 17B cont'd

```
TTAAGTATCTGGGAAGTCTTGTGCAGTATTGGGGCCTGGAACTAAAAAGGAGTGCTATTAGTCTATTGGATACCCTA
GCAATAGCAGTAGGTGAGGGAACAGATAGGATTCTAGAATTTGTATTAGGAATTTGTAGAGCTATCCGCAACATACC
TACAAGAATAAGACAGGGCTTTGAAACAGCTTTGCTATAA
>703010505.N136.B19
ATGAGAGTGAGGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGACAGCAATAGCAATATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGGTGGCAGCTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAATAGTACATCTCAATGAATCTGTAA
AGATTGAGTGTACGAGACCCAGTAATAACACAAGAACAAGTATAAGAATAGGACCAGGACAAGCACATTGTAACATT
AGTGAAAGTAAATGGAATGAGACTTTACAAAGGGTAAGTGAAAAATTAAAAAAATACTTCCCTGATAAGAATATAAC
ATTTCGACCATCCTCAGGAGGGGACCTAGAAATTACAACACATAGCTTTAATTGTGGAGGAGAATTTTTCTATTGCA
ATACATCAAGCCTGTTTAATAGGACATATATGGCTACTAGTACAGATATGGCTAATAGTACAGAAACTAACAGTACA
CGAATCATCACAATCCACTGCAGAATAAAACAAATTATAAACATGTGGCAGGAGGTGGGACGAGCAATGTATGCCCC
TCCCATTGCAGGAAAACATAACATGTATATCAAATATCACAGGACTACTATTGACAAGGGATGGAGGAAACAATACAG
AGGATACGGAGACATTCAGACCTGAAGGAGGAAATATGAAGGACAATTGGAGAAGTGAATTATATAAATATAAAGTG
GTAGAAGTTAAGCCATTAGGAGTAGCACCCACTAATGCAAGAAGGAGAGTGGTGGAGAGAGAAAAAAGAGCAGTGGG
AATGGGAGCTGTGTTCCTTGGGTTCTTGGGAGCGGCAGGAAGCACTATGGGCGCAGCATCAATAACGCTGACGGTAC
AGGCCAGACAATTATTGTCTGGTATAGTGCAACAGCAAATTTGCTGAAGGCTATAGAGGCTCAACAGCATATG
TTGAAACTCACGGTCTGGGGCATTAAACAGCTCCAGGCAAGAGTCCTGGCCTTGGAAAGATACCTAAAGGATCAACA
GCTCCTAGGGATGTGGGGCTGCTCTGGAAAACTCATCTGCACCACTAATGTATATTGGAACTCTAGCTGGAGTAATA
AAACTTATGATGATATTTGGGATAACATGACCTGGATGCAGTGGGAGAGAGAAATTAGCAATTATACAAACATAATA
TATGAATTGCTTGAAGAATCACAAAACCAGCAGGAAAAGAATGAACAAGATTTACTAGCATTGGACAGATGGAACAG
TCTGTGGAATTGGTTTAACATAACAAATTGGCTGTGTATAAAATATTCATAATGATAGTAGGAGGCTTGATAGGTTGAGGAGCTTGATAG
GTTTAAGAATAATTTTTGCTGTGCTTTCTTTAGTAAATAGAGTTAGGCAGGGATACTCACCTCTGTCATTGCAGACC
CTTATCCCAAGCCCGAGGGGACCAGACAGGCCCGGAGGAATCGAAGAAGAAGGTGGAGAGCAAGACAGAAACAGATC
AACGCGATTAGTGAGCGGATTCTTAGCGCTTGCCTGGGACGACCTGCGGAGCCTGTGCCTTTTCATCTACCACCGAT
TGAGAGACTTCATATTAATTGCAGCGAGAGCGGGGGAACTTCTGGGACGCAGCAGTCTCAAGGGACTACGGAGAGGG
TGGGAAGCCCTTAAGTATCTGGGAAGTCTTGTGCAGTATTGGGGCCTGGAACTAAAAAGGAGTGCTATTAGTCTATT
GGATACCCTAGCAATAGCAGTAGGTGAGGGAACAGATAGGATTCTAGAATTTGTATTAGGAATTTGTAGAGCTATCC
GCAACATGCCTACAAGAATAAGACAGGGCTTTGAAACAGCTTTGCTATAA
>703010505.N136.B10
ATGAGAGTGATGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTTAACATGTGGAAAAATGACATGGTGGATCAGATGCATGAAGA
TGTAATTAGTTTATGGGATCAAAGCCTCAAGCCATGTGTAAAGTTGACCCCACTCTGCGTCACTCTAAGCTGTATCA
ATGCTACTAATGCTACTGACAGCAATAACAGTATATTAGAGGGAATGAAAAATTGCTCTTTCAATATAACCACAGAA
TTAAGAGATAAGAGAGAGAAAAAGAATGCACTTTTTTATAAACTTGATATAGTACAACTATATGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACTCATGGAATTAAGCCAGTGGTTTCAACTCAACTATTGTTAAATGGTAGCCTAGCAGA
AGGAGAGATAATAATTAGATCTAAAAATATAACAGACAATGGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAGGAATGGAATAAACTTTACAAAGGGT
AAGTGAAAAATTAAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCTAGCCTGTTTAATAGGACATATATGGCT
ACTAGTACAGATATGGCTAATAGTACAGAAACTAACAGTACACGAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAACAATACAGAGGATACGGAGACATTCAGACCTGAAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGTTGGAGTAATAAAACTTATAGTGATATTTGGGATAACATGACCTGG
ATGCAGTGGGAGAGAGAAATTAGCAATTATACAGACATGATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGGGCA
GTATTGGGGCCTGGAACTAAAAAGGAGTGCTATTAGTCTATTGGATACCCTAGCAATAGCAGTAGGTGAGGGAACAG
```

FIG. 17B cont'd

ATAGGATTCTAGAATTTGTATTAGGAATTTGTAGAGCTATCCGCAACATACCTACAAGAATAAGACAGGGCTTTGAA
ACAGCTTTGCTATAA
>703010505.W136.B27
ATGAGAGTGAGGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTTAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGCCAGCAATAGCAATATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAAACTTTACAAAGGGT
AAGTGAAAAATTAAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
AATAGTACAGATATGGCTAATAGTACAGAAACTAACAGTACACGAATCATCACACTCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAACAATACAGAGGATACGGAGACATTCAGACCTGAAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGCTGGAGTAATAAAACTTATGATGATATTTGGGATAACATGACCTGG
ATGCAGTGGGAGAGAGAAATTAGCAATTATACAGACATGATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGAACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAGGGAACAG
ATAGGATTCTAGAATTTGTATTAGGAATTTGTAGAGCTATCCGCAACATACCTACAAGAATAAGACAGGGCTTTGAA
ACGGCTTTGCTATAA
>703010505.W136.B12
GAGAGTGATGGGGATACAGAGGAATTATCCACAATGGTGGATATGGAGCATGTTAGGCTTTTGGATGCTAATGATTT
GTAATGGGATGTGGGTCACAGTCTACTATGGGGTACCTGTGTGGAAAGAAGCAAAAACTACTCTATTTTGTGCATCA
GATGCTAAAGCATATGAGAAAGAAGTGCATAATGTCTGGGCTACACATGCCTGTGTACCCACAGACCCCAATCCACA
AGAAATGGTTTTAAAAAATGTAACAGAAAATTTCAACATGTGGAAAAATGACATGGTGGATCAGATGCATGAAGATG
TAATTAGTTTATGGGATCAAAGCCTCAAGCCATGTGTAAAGTTGACCCCACTCTGTGTCACTCTAAACTGTATCAAT
GCTACTAATGCTACTGCAGCAATAGCAATATATTAGAGGGAATGAAAAATTGCTCTTTCAATATAACCACAGAATT
AAGAGATAAGAGAGAGAAAAAGAATGCACTTTTTTATAAACTTGATATAGTACAACTAGGTGGCAACTCTAGTCAGT
ATAGATTAATAAATTGTAATACCTCAGTCATAACACAAGCCTGTCCAAAGGTCTCTTTTGACCCAATTCCTATACAT
TATTGTGCTCCAGCTGGTTATGCGATTCTAAAGTGTAATAATAAGACATTCAATGGAACAGGACCGTGTAATAATGT
CAGCACAGTACAATGTACACATGGAATTAAGCCAGTGGTTTCAACTCAACTATTGTTAAATGGTAGCCTAGCAGAAG
GAGAGATAATAATTAGATCTAAAAATATAACAGACAATAGCAAAACAATAATAGTACATCTCAATGAATCTGTAAAG
ATTGAGTGTACGAGACCCAGTAATAACACAAGAACAAGTATAAGAATAGGACCAGGACAAGCATTTTATGCAACAGG
ACAAGTAATAGGAAATATAAGAGAAGCACATTGTAACATTAGTGAAAGTAAATGGACTGAGACTTTACAAAGGGTAA
GTGAAAAATTAAAAAAATACTTCCCTGATAAGAATATAACATTTCGACCATCCTCAGGAGGGGACCTAGAAATTACA
CACATAGCTTTAATTGTGGAGGAGAATTTTTCTATTGCAATACATCAAGCCTGTTTAATAGGACATATATGGCTAC
TAGTACAGATATGGCTAATAGTACAGAAATTAACAGTACTCACCACGAATCATCACTCCACTGCAGAATAAAACAAATTA
TAAACATGTGGCAGGAGGTGGGACGAGCAATGTATGCCCCTCCCATTGCAGGAAACATAACATGTATATCAAATATC
ACAGGACTACTATTGACAAGGGATGGAGGAAACAATACAGAGGATACGGAGACATTCAGACCTGAAGGAGGAAATAT
GAAGGACAATTGGAGAAGTGAATTATATAAATATAAAGTGGTAGAAGTTAAGCCATTAGGAGTAGCACCCACTAATG
CAAGAAGGAGAGTGGTGGAGAGAGAAAAAGAGCAGTGGGAATGGGAGCTGTGTTCCTTGGGTTCTTGGGAGCGGCA
GGAAGCACTATGGGCGCAGCATCAATAACGCTGACGGTACAGGCCAGACAATTATTGTCTGGTATAGTGCAACAGCA
AAGCAATTTGCTGAAGGCTATAGAGGCTCAACAGCATATGTTGAAACTCACGGTCTGGGGCATTAAACAGCTCCAGG
CAAGAGTCCTGGCCTTGGAAAGATACCTAAAGGATCAACAGCTCCTAGGGATGTGGGGCTGCTCTGGAAAACTCATC
TGCACCACTAATGTATATTGGAACTCTAGCTGGAGTAATAAAACTTATGATGATATTTGGGATAACATGACCTGGAT
GCAGTGGGAGAGAGAAATTAGCAATTATACAAACATAATATATGAATTGCTTGAAGAATCACAAAACCAGCAGGAAA
AGAATGAACAAGATTTACTAGCATTGGACAGATGGAACAGTCTGTGGAATTGGTTTAACATAACAAATTGGCTGTGG
TATATAAAAATATTCATAATGATAGTAGGAGGCTTGATAGGTTTAAGAATAATTTTTGCTGTGCTTCTTTAGTAAA
TAGAGTTAGGCAGGGATACTCACCTCTGTCATTGCAGACCCTTATCCCAAGCCCGAGGGGACCAGACAGGCCCGGAG
GAATCGAAGAAGAAGGTGGAGAGCAAGACAGAAACAGATCAACGCGATTAGTGAGCGGATTCTTAGCGCTTGCCTGG
GACGACCTGCGGAGCCTGTGCCTTTTCATCTACCACCGATTGAGAGACTTCATATTAATTGCAGCGAGAGCGGGGA
ACTTCTGGGACGCAGCAGTCTCAAGGGACTACGGAGAGGGTGGGAAGCCCTTAAGTATCTGGGAAGTCTTGTGCAGT
ATTGGGGCCTGGAACTAAAAAGGAGTGCTATTAGTCTATTGGATACCCTAGCAATAGCAGTAGGTGAGGGAACAGAT

FIG. 17B cont'd

AGGATTCTAGAATTTGTATTAGGAATTTGTAGAGCTATCCGCAACATACCTACAAGAATAAGACAGGGCTTTGAAAC
AGCTTTGCTATAA
>703010505.W136.B16
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGACAGCAATAGCAATATATTAGAGGGAATGAAAAATTGCTCTTTCAATATAACCACAGAA
TTAAGAGATAAGAGAGAGAAAAAGAATGCACTTTTTTATAAACTTGATATATAGTACAACTAGGTGGCAACTCTAGT
CAGTATAGATTAATAAATTGTAAATACCTCAGTCATAACACAAGCCTGTCCAAAGGTCTCTTTTTGACCCAATTCCTAT
ACATTATTGTGCTCCAGCTGGTTATGCGATTCTAAAGTGTAATAATAAGACATTCAATGGAACAGGACCGTGTAATA
ATGTCAGCACAGTACAATGTACACATGGAATTAAGCCAGTGGTTTCAACTCAACTATTGTTAAATGGTAGCCTAGCA
GAAGGAGAGATAATAATTAGATCTAAAAATATAACAGACAATAGCAAAACAATAATAGTACATCTCAATGAATCTGT
AAAGATTGAGTGTACGAGACCCAGTAATAACACAAGAACAAGTATAAGAATAGGACCAGGACAAGCATTTTATGCAA
CAGGACAAGTAATAGGAAATATAAGAGAAGCACATTGTAACATTAGTGAAAGTAAATGGAATGAGACTTTACAAAGG
GTAAGTGAAAAATTAAAAAAATACTTCCCTGATAAGAATATAACATTTCGACCATCCTCAGGAGGGGACCTAGAAAT
TACAACACATAGCTTTAATTGTGGAGGAGAATTTTTCTATTGCAATACATCAAGCCTGTTTAATAGGACATATATGG
CTACTAGTACAGATATGGCTAATAGTACAGAAACTAACAGTACACGAATCATCACAATCCACTGCAGAATAAAACAA
ATTATAAACATGTGGCAGGAGGTGGGACGAGCAATGTATGCCCCTCCCATTGCAGGAAACATAAACATGTATATCAAA
TATCACAGGACTACTATTGACAAGGGATGGAGGAAACAATACAGAGGATACGGAGACATTCAGACCTGAAGGAGGAA
ATATGAAGGACAATTGGAGAAGTGAAATTATATAAATATAAAGTGGTAGAAGTTAAGCCATTAGGAGTAGCACCCACT
AATGCAAGAAGGAGAGTGGTGGAGAGAAAAAAGAGCAGTGGGAATGGGAGCTGTGTTCCTTGGGTTCTTGGGAGC
GGCAGGAAGCACTATGGGCGCAGCATCAATAACGCTGACGGTACAGGCCAGACAATTATTGTCTGGTATAGTGCAAC
AGCAAAGCAATTTGCTGAAGGCTATAGAGGCTCAACAGCATATGTTGAAACTCACGGTCTGGGGCATTAAACAGCTC
CAGGCAAGAGTCCTGGCCTTGGAAAGATACCTAAAGGATCAACAGCTCCTAGGGATGTGGGGCTGCTCTGGAAAACT
CATCTGCACCACTAATGTATATTGGAACTCTAGCTGGAGTAATAAAACTTATGATGATATTTGGGATAACATGACCT
GGATGCAGTGGGAGAGAGAAATTAGCAATTATACAAACATAATATATGAATTGCTTGAAGAATCGCAAAACCAGCAG
GAAAAGAATGAACAAGATTTACTAGCATTGGACAGATGGAACAGTCTGTGGAATTGGTTTAACATAACAAATTGGCT
GTGGTATATAAAAATATTCATAATGATAGTAGGAGGCTTGATAGGTTTAAGAATAATTTTTGCTGTGCTTTCTTTAG
TAAATAGAGTTAGGCAGGGATACTCACCTCTGTCATTGCAGACCCCTTATCCCAAGCCCGAGGGGACCAGACAGGCCC
GGAGGAATCGAAGAAGAAGGTGGAGAGCAAGACAGAAACAGATCAACGCGATTAGTGAGCGGATTCTTAGCGCTTGC
CTGGGACGACCTGCGGAGCCTGTGCCTTTTCATCTACCACCGATTGAGAGACTTCATATTAATTGCAGCGAGAGCGG
GGGAACTTCTGGGACGCAGCAGTCTCAAGGGACTACGGAGAGGGTGGGAAGCCCTTAAGTATCTGGGAAGTCTTGTG
CAGTATTGGGGCCTGGAACTAAAAAGGAGTGCTATTAGTCTATTGGATACCCTAGCAATAGCAGTAGGTGAGGGAAC
AGATAGGATTCTAGAATTTGTATTAGGAATTTGTAGAGCTATCCGCAACATACCTACAAGAATAAGACAGGGCTTTG
AAACAGCTTTGCTATAA
>703010505.W136.T2
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGACAGCAATAGCAATATATTAGAGGGAATGAAAAATTGCTCTTTCAATATAACCACAGAA
TTAAGAGATAAGAGAGAGAAAAAGAATGCACTTTTTTATAAACTTGATATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTGATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAGACTTTACAAAGGGT
AAGTGAAAAATTAAAAAAATACTTCCCTGATAAGAATATAACATTTCGACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
ACTAGTACAGATATGGCTAATAGTACAGAAACTAACAGTACACGAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAACAATACAGAGGATACGGAGACATTCAGACCTGAAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGCTGGAGTAATAAAACTTATGATGATATTTGGGATAACATGACCTGG
ATGCAGTGGGAGAGAGAAATTAGCAATTATACAAACATAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCCTTATCCCAAGCCCGAGGGGACCAGACAGGCCCA
GGAATGCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCAGCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAGGGAACAG

FIG. 17B cont'd

```
ATAGGATTCTAGAATTTGTATTAGGAATTTGTAGAGCTATCCGCAACATACCTACAAGAATAAGACAGGGCTTTGAA
ACAGCTTTGCTATAA
>703010505.W136.B9
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGACAGCAATAGCAATATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAGACTTTACAAAGGGT
AAGTGAAAAATTAAAAAAATACTTCCCTGATAAGAATATAACATTTCGACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
ACTAGTACAGATATGGCTAATAGTACAGAAACTAACAGTACACGAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAACAATACAGAGGATACGGAGACATTCAGACCTGAAGGAGGAGAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAAGATACCTAAAGGATCAACAGCTCCTAGGGATGTGGGGCTGCTCTGGAAAACTCA
TCTGCACCACTAATGTATATTGGAACTCTAGCTGGAGTAATAAAACTTATGATGATATTTGGGATAACATGACCTGG
ATGCAGTGGGAGAGAGAAATTAGCAATTATACAAACATAATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGGTAGGTTTAAGAATAATTTTTGCTGTGCTTTCTTTAGTA
AATAGAGTTAGGCAGGGATACTCACCTCTGTCATTGCAGACCCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAGGGAACAG
ATAGGATTCTAGAATTTGTATTAGGAATTTGTAGAGCTATCCGCAACATACCTACAAGAATAAGACAGGGCTTTGAA
ACAGCTTTGCTATAA
>703010505.W136.B4
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTATTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGACAGCAATAGCAATATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAGACTTTACAAAGGGT
AAGTGAAAAATTAAAAAAATACTTCCCTGATAAGAATATAACATTTCGACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
ACTAGTACAGATATGGCTAATAGTACAGAAACTAACAGTACACGAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAACAATACAGAGGATACGGAGACATTCAGACCTGAAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAAGATACCTAAAGGATCAACAGCTCCTAGGGATGTGGGGCTGCTCTGGAAAACTCA
TCTGCACCACTAATGTATATTGGAACTCTAGCTGGAGTAATAAAACTTATGATGATATTTGGGATAACATGACCTGG
ATGCAGTGGGAGAGAGAAATTAGCAATTATACAAACATAATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAGGGAACAG
```

FIG. 17B cont'd

ATAGGATTCTAGAATTTGTATTAGGAATTTGTAGAGCTATCCGCAACATACCTACAAGAATAAGACAGGGCTTTGAA
ACAGCTTTGCTATAA
>703010505.W136.B25
ATGAGAGTGAGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGACAGCAATAGCAATATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAGACTTTACAAAGGGT
AAGTGAAAAATTAAAAAAATACTTCCCTGATAAGAATATAACATTTCGACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
ACTAGTACAGATATGGCTAATAGTACAGAAACTAACAGTACACGAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAACAATACAGAGGATACGGAGACATTCAGACCTGAAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGCTGGAGTAATAAAACTTATGATGATATTTGGGATAACATGACCTGG
ATGCAGTGGGAGAGAGAAATTAGCAATTATACAAACATAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAGGGAACAG
ATAGGATTCTAGAATTTGTATTAGGAATTTGTAGAGCTATCCGCAACATACCTACAAGAATAAGACAGGGCTTTGAA
ACAGCTTTGCTATAA
>703010505.W136.B11
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGACAGCAATAGCAATATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTACTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAGACTTTACAAAGGGT
AAGTGAAAAATTAAAAAAATACTTCCCTGATAAGAATATAACATTTCGACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
ACTAGTACAGATATGGCTAATAGTACAGAAACTAACAGTACACGAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAACAATACAGAGGATACGGAGACATTCAGACCTGAAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGCTGGAGTAATAAAACTTATGATGATATTTGGGATAACATGACCTGG
ATGCAGTGGGAGAGAGAAATTAGCAATTATACAAACATAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAGGGAACAG

FIG. 17B cont'd

ATAGGATTCTAGAATTTGTATTAGGAATTTGTAGAGCTATCCGCAACATACCTACAAGAATAAGACAGGGCTTTGAA
ACAGCTTTGCTATAA
>703010505.W136.B14
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGACAGCAATAGCAATATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAGACTTTACAAAGGGT
AAGTGAAAAATTAAAAAAATACTTCCCTGATAAGAATATAACATTTCGACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
ACTAGTACAGATATGGCTAATAGTACAGAAACTAACAGTACACGAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAACAATACAGAGGATACGGAGACATTCAGACCTGAAGGAGGAAAT
ATGAAGGACAATTGGAGAAGTGAATTATATAAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGCATTAAACAGCTCCA
GGCAAGAGTCCTGGCCTTGGAAAGATACCTAAAGGATCAACAGCTCCTAGGGATGTGGGCTGCTCTGGAAAACTCA
TCTGCACCACTAATGTATATTGGAACTCTAGCTGGAGTAATAAAACTTATGATGATATTTGGGATAACATGACCTGG
ATGCAGTGGGAGAGAGAAATTAGCAATTATACAAACATAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGTGGGAAGCCCTTAAGTATCTGGGAAGTCTTGGGCA
GTATTGGGGCCTGGAACTAAAAAGGAGTGCTATTAGTCTATTGGATACCCTAGCAATAGCAGTAGGTGAGGGAACAG
ATAGGATTCTAGAATTTGTATTAGGAATTTGTAGAGCTATCCGCAACATACCTACAAGAATAAGACAGGGCTTTGAA
ACAGCTTTGCTATAA
>703010505.W136.B29
ATGAGAGTGAGGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGACAGCAATAGCAATATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTAATAACACAAGAACAAGTATAAGGATAGGACCAGGACAAGCATTTTATGCAACA
GGACAAGTAATAGGAAATATAAGAGAAGCACATTGTAACATTAGTGAAAGTAAATGGAATGAGACTTTACAAAGGGT
AAGTGAAAAATTAAAAAAATACTTCCCTGATAAGAATATAACATTTCGACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
ACTAGTACAGATATGGCTAATAGTACAGAAACTAACAGTACACGAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAACAATACAGAGGATACGGAGACATTCAGACCTGAAGGAGGAAAT
ATGAAGGACAATTGGAGAAGTGAATTATATAAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGCATTAAACAGCTCCA
GGCAAGAGTCCTGGCCTTGGAAAGATACCTAAAGGATCAACAGCTCCTAGGGATGTGGGCTGCTCTGGAAAACTCA
TCTGCACCACTAATGTATATTGGAACTCTAGCTGGAGTAATAAAACTTATGATGATATTTGGGATAACATGACCTGG
ATGCAGTGGGAGAGAGAAATTAGCAATTATACAAACATAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGTGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAGGGAACAG

FIG. 17B cont'd

ATAGGATTCTAGAATTTGTATTAGGAATTTGTAGAGCTATCCGCAACATACCTACAAGAATAAGACAGGGCTTTGAA
ACAGCTTTGCTATAA
>703010505.W136.B8
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGGAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGACAGCAATAGCAATATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAGACTTTACAAAGGGT
AAGTGAAAAATTAAAAAAATACTTCCCTGATAAGAATATAACATTTCGACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
ACTAGTACAGATATGGCTAATAGTACAGAAACTAACAGTACACGAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAACAATACAGAGGATACGGAGACATTCAGACCTGAAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGCTGGAGTAATAAAACTTATGATGATATTTGGGATAACATGACCTGG
ATGCAGTGGGAGAGAGAAATTAGCAATTATACAAACATAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAGGGAACAG
ATAGGATTCTAGAATTTGTATTAGGAATTTGTAGAGCTATCCGCAACATACCTACAAGAATAAGACAGGGCTTTGAA
ACAGCTTTGCTATAA
>703010505.W136.B37
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGGAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGACAGCAATAGCAATATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAGAATATAAGAGAAGCACATTGTAACATTGAAAGTGAAAGTAAATGGAATGAGACTTTACAAAGGGT
AAGTGAAAAATTAAAAAAATACTTCCCTGATAAGAATATAACATTTCGACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
ACTAGTACAGATATGGCTAATAGTACAGAAACTAACAGTACACGAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAACAATACAGAGGATACGGAGACATTCAGACCTGAAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGCTGGAGTAATAAAACTTATGATGATATTTGGGATAACATGACCTGG
ATGCAGTGGGAGAGAGAAATTAGCAATTATACAAACATAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAAGGAACAG

FIG. 17B cont'd

ATAGGATTCTAGAATTTGTATTAGGAATTTGTAGAGCTATCCGCAACATACCTACAAGAATAAGACAGGGCTTTGAA
ACAGCTTTGCTATAA
>703010505.W136.T1
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGGAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGACAGCAATAGCAATATATTAGAGGGAATGAAAAATTGCTCTTTCAATATAACCACAGAA
TTAAGAGATAAGAGAGAGAAAAAGAATGCACTTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAGACTTTACAAAGGGT
AAGTGAAAAATTAAAAAAAATACTTCCCTGATAAGAATATAACATTTCGACCATCCTCAGGAGGGGACCTAGAAATT
ACAACACATAGCTTTAATTGTGGAGGAGAATTTTTCTATTGCAATACATCAAGCCTGTTTAATAGGACATATATGGC
TACTAGTACAGATATGGCTAATAGTACAGAAACTAACAGTACACGAATCATCACAATCCACTGCAGAATAAAACAAA
TTATAAACATGTGGCAGGAGGTGGGACGAGCAATGTATGCCCCTCCCATTGCAGGAAACATAACATGTATATCAAAT
ATCACAGGACTACTATTGACAAGGGATGGAGGAAACAATACAGAGGATACGGAGACATTCAGACCTGAAGGAGGAAA
TATGAAGGACAATTGGAGAAGTGAATTATATAAATATAAAGTGGTAGAAGTTAAGCCATTAGGAGTAGCACCCACTA
ATGCAAGAAGGAGAGTGGTGGAGAGAGAAAAAAGAGCAGTGGGAATGGGAGCTGTGTTCCTTGGGTTCTTGGGAGCG
GCAGGAAGCACTATGGGCGCAGCATCAATAACGCTGACGGTACAGGCCAGACAATTATTGTCTGGTATAGTGCAACA
GCAAAGCAATTTGCTGAAGGCTATAGAGGCTCAACAGCATATGTTGAAACTCACGGTCTGGGCATTAAACAGCTCC
AGGCAAGAGTCCTGGCCTTGGAAAGATACCTAAAGGATCAACAGCTCCTAGGGATGTGGGGCTGCTCTGGAAAACTC
ATCTGCACCACTAATGTATATTGGAACTCTAGCTGGAGTAATAAAACTTATGATGATATTTGGGATAACATGACCTG
GATGCAGTGGGAGAGAGAAATTAGCAATTATACAAACATAATATATGAATTGCTTGAAGAATCACAAAACCAGCAGG
AAAAGAATGAACAAGATTTACTAGCATTGGACAGATGGAACAGTCTGTGGAATTGGTTTAACATAACAAATTGGCTG
TGGTATATAAAAATATTCATAATGATAGTAGGAGGCTTGATAGGTTTAAGAATAATTTTTGCTGTGCTTTCTTTAGT
AAATAGAGTTAGGCAGGGATACTCACCTCTGTCATTGCAGACCCTTATCCCAAGCCCGAGGGGACCAGACAGGCCCG
GAGGAATCGAAGAAGAAGGTGGAGAGCAAGACAGAAACAGATCAACGCGATTAGTGAGCGGATTCTTAGCGCTTGCC
TGGGACGACCTGCGGAGCCTGTGCCTTTTCATCTACCACCGATTGAGAGACTTCATATTAATTGCAGCGAGAGCGGG
GGAACTTCTGGGACGCAGCAGTCTCAAGGGACTACGGAGAGGGTGGGAAGCCCTTAAGTATCTGGGAAGTCTTGTGC
AGTATTGGGGCCTGGAACTAAAAAGGAGTGCTATTAGTCTATTGGATACCCTAGCAATAGCAGTAGGTGAAGGAACA
GATAGGATTCTAGAATTTGTATTAGGAATTTGTAGAGCTATCCGCAACATACCTACAAGAATAAGACAGGGCTTTGA
AACAGCTTTGCTATAA
>703010505.W136.B35
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAACCTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGGAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGACAGCAATAGCAATATATTAGAGGGAATGAAAAATTGCTCTTTCAATATAACCACAGAA
TTAAGAGATAAGAGAGAAAAAGAATGCACTTTTTTATAAACTTGATATAGTACAACTAGGTGGCAACTCTAGTCA
GTATAGATTAATAAATTGTAATACCTCAGTCATAGCACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAGACTTTACAAAGGGT
AAGTGAAAAATTAAAAAAAATACTTCCCTGATAAGAATATAACATTTCGACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
ACTAGTACAGATATGGCTAATAGTACAGAAACTAACAGTACACGAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAACAATACAGAGGATACGGAGACATTCAGACCTGAAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGCTGGAGTAATAAAACTTATGATGATATTTGGGATAACATGACCTGG
ATGCAGTGGGAGAGAGAAATTAGCAATTATACAAACATAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
AACTTCTGGGACGCAGCAGTCTCAAGGGACTACGGAGAGGGTGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAAGGAACAG

FIG. 17B cont'd

```
ATAGGATTCTAGAATTTGTATTAGGAATTTGTAGAGCTATCCGCAACATACCTACAAGAATAAGACAGGGCTTTGAA
ACAGCTTTGCTATAA
>703010505.W136.B36
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGGAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGACAGCAATAGCAATATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAAPAAGGCATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAGACTTTACAAAGGGT
AAGTGAAAAATTAAAAAAATACTTCCCTGATAAGAATATAACATTTCGACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
ACTAGTACAGATATGGCTAATAGTACAGAAACTAACAGTACACGAATCATCACAATCCATTGCAGAATAAAACAAAT
TATAAACATGTGGCAGGAGGTGGGACAGCAATGTATGCCCCTCCCATTGCAGGAAACATAACATGTATATCAAATA
TCACAGGACTACTATTGACAAGGGATGGAGGAAACAATACAGAGGATACGGAGACATTCAGACCTGAAGGAGGAAAT
ATGAAGGACAATTGGAGAAGTGAATTATATAAATATAAAGTGGTAGAAGTTAAGCCATTAGGAGTAGCACCCACTAA
TGCAAGAATGAGAGTGGTGGAGAGAGAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGGCTCAACAGCACATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGCTGGAGTAATAAAACTTATGATGATATTTGGGATAACATGACCTGG
ATGCAGTGGGAGAGAGAAATTAGCAATTATACAAACATAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAAGGAACAG
ATAGGATTCTAGAATTTGTATTAGGAATTTGTAGAGCTATCCGCAACATACCTACAAGAATAAGACAGGGCTTTGAA
ACAGCTTTGTTATAA
>703010505.W136.B22
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGGAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGACAGCAATAGCAATATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAGACTTTACAAAGGGT
AAGTGAAAAATTAAAAAAATACTTCCCTGATAAGAATATAACATTTCGACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
ACTAGTACAGATATGGCTAATAGTACAGAAACTAACAGTACACGAATCATCACAATCCACTGCAGAATAAAACAAAT
TATAAACATGTGGCAGGAGGTGGGACAGCAATGTATGCCCCTCCCATTGCAGGAAACATAACATGTATATCAAATA
TCACAGGACTACTATTGACAAGGGATGGAGGAAACAATACAGAGGATACGGAGACATTCAGACCTGAAGGAGGAAAT
ATGAAGGACAATTGGAGAAGTGAATTATATAAATATAAAGTGGTAGAAGTTAAGCCATTAGGAGTAGCACCCACTAA
TGCAAGAAGGAGAGTGGTGGAGAGAGAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATCGGAACTCTAGCTGGAGTAATAAAACTTATGATGATATTTGGGATAACATGACCTGG
ATGCAGTGGGAGAGAGAAATTAGCAATTATACAAACATAATATATGAATTGCTTGAAGAATCACAAAACCAGCAGGA
AAAGAATGAACAAGATTTACTAGCACTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAAGGAACAG
```

FIG. 17B cont'd

ATAGGATTCTAGAATTTGTATTAGGAATTTGTAGAGCTATCCGCAACATACCTACAAGAATAAGACAGGGCTTTGAA
ACAGCTTTGCTATAA
>703010505.W136.E26
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAGAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGGAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGACAGCAATAGCAATATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGATAATAGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAGACTTTACAAAGGGT
AAGTAAAAAATTAAAAAAATACTTCCCTGATAAGAATATAACATTTCGACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
ACTAGTATAGATATGGCTAATAGTACAGAAACTAACAGTACACGAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAACAATACAGAGGATACGGAGACATTCAGACCTGAAGGAGGAAAT
ATGAAGGACAATTGGAGAAGTGAATTATATAAATATAAAGTGGTAGAAGTTAAGCCATTGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGCTGGAGTAATAAAACTTATGATGATATTTGGGATAACATGACCTGG
ATGCAGTGGGAGAGAGAAATTAGCAATTATACAAACATAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAAAGTTAGGCAGGGATACTCACCTCTGTCATTGCAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGAGAGGGTGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAAGGAACAG
ATAGGATTCTAGAATTTGTATTAGGAATTTGTAGAGCTATCCGCAACATACCTACAAGAATAAGACAGGGCTTTGAA
ACAGCTTTGCTATAA
>703010505.W136.E28
ATGAGAGTGAGGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGGAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGACAGCAATAGCAATATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGATAATAGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAGACTTTACAAAGGGT
AAGTGAAAAATTAAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
AATAGTACAGATATGGCTAATAGTACAGAAACTAACAGTACACGAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAACGATACGGATACGGATACGGAGACATTCAGACCTGAAGGAGGA
AATATGAAGGACAATTGGAGAAGTGAATTATATAAATATAAAGTGGTAGAAGTTAAGCCATTAGGAGTAGCACCCAC
TAATGCAAGAAGGAGAGTGGTGGAGAGAGAAAAAAGAGCAGTGGGAATGGGAGCTGTGTTCCTTGGGTTCTTGGGAG
CGGCAGGAAGCACTATGGGCGCAGCATCAATAACGCTGACGGTACAGGCCAGACAATTATTGTCTGGTATAGTGCAA
CAGCAAAGCAATTTGCTGAAGGCTATAGAGGCTCAACAGCATATGTTGAAACTCACGGTCTGGGGCATTAAACAGCT
CCAGGCAAGAGTCCTGGCCTTGGAAAGATACCTAAAGGATCAACAGCTCCTAGGGATGTGGGGCTGCTCTGGAAAAC
TCATCTGCACCACTAATGTATATTGGAACTCTAGTTGGAGTAATAAAACTTATAGTGATATTTGGGATAACATGACC
TGGATGCAGTGGGAGAGAGAAATTAGCAATTATACAAACATAATATATGACTTGCTTGAAGAATCACAAAACCAGCA
GGAAAAGAATGAACAAGATTTACTAGCATTGGACAGATGGAACAGTCTGTGGAATTGGTTTAACATAACAAATTGGC
TGTGGTATATAAAAATATTCATAATGATAGTAGGAGGCTTGATAGGTTTAAGAATAATTTTTGCTGTGCTTTCTTTA
GTAAATAGAGTTAGGCAGGGATACTCACCTCTGTCATTGCAGACCCTTATCCCAAGCCCGAGGGGACCAGACAGGCC
CGGAGGAATCGAAGAAGAAGGTGGAGAGCAAGACAGAAACAGATCAACGCGATTAGTGAGCGGATTCTTAGCGCTTG
CCTGGGACGACCTGCGGAGCCTGTGCCTTTTCATCTACCACCGATTGAGAGACTTCATATTAATTGCAGCGAGAGCG
GGGGAACTTCTGGGACGCAGCAGTCTCAAGGGACTACGAGAGGGTGGGAAGCCCTTAAGTATCTGGGAAGTCTTGT
GCAGTATTGGGGCCTGGAACTAAAAAGGAGTGCTATTAGTCTATTGGATACCCTAGCAATAGCAGTAGGTGAGGGAA

FIG. 17B cont'd

```
CAGATAGGATTCTAGAATTTGTATTAGGAATTTGTAGAGCTATCCGCAACATACCTACAAGAATAAGACAGGGCTTT
GAAACAGCTTTGCTATAA
>703010505.W136.B5
ATGAGAGTGATGGGGACACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGCGGATCAGATGCATGAAGA
TGTAATTAGTTTATGGGATCAAAGCCTCAAGCCATGTGTAAAGTTGACCCCACTCTGTGTCACTCTATACTGTATCA
ATGCTACTGCCAATGCTACTGTCAGCAATAGCAGTATAATAGAGGAAATGAAAAATTGCTCTTTCAATATAACCACA
GAATTAAGAGATAAGAGAGAGAAAAAGAATGCACTTTTTTATAAACTTGATATAGTACAACTAGATGGCAACTCTAG
TCAGTATAGATTAATAAATTGTAATACCTCAGCCATAACACAAGCCTGTCCAAAGGTCTCTTTTGACCCAATTCCTA
TACATTATTGTGCTCCAGCTGGTTATGCGATTCTAAAGTGTAATAATAAGACATTCAATGGAACAGGACCGTGTAAT
AATGTCAGCACAGTACAATGTACACATGGAATTAAGCCAGTGGTTTCAACCCAACTATTGTTAAATGGTAGCCTAGC
AGAAGGAGAGATAATAATTAGATCTGAAAATATAACAAACAGTGCCAAAACAATAATAGTACATCTCAATGAATCTG
TAAAGATTGAGTGTACGAGACCCAGTAATAACACAAGAACAAGTATAAGAATAGGACCAGGACAAGCATTTTATGCA
ACAGGACAAGTAATAGGAGACATAAGACAAGCACATTGTAACATTAGTGAAAGTAAATGGAATGAAACTTTACAAAG
GGTAAGTGAAAAATTAAAAGAATACTTCCCTAATAAGACTATAACATTTCAACCATCCTCAGGAGGGGACCCAGAAA
TTACAACACATAGCTTTAATTGTGGAGGAGAATTTTTCTATTGCAATACATCAAGCCTGTTTAATAGGACATATATG
GCTAATAGTACAGATATGGCTAATAGTACAGAAACTAACAGTACACGAACCATCACACTCCACTGCAGAATAAAACA
AATTATAAACATGTGGCAAGAGGTGGGACGAGCAATGTATGCCCCTCCCATTGCAGGAAACATAACATGTATATCAA
ATATCACAGGACTACTATTGACAAGGGATGGAGGAAAACAGCAGTAAGGAGACAGAGACATTCAGACCTGGAGGAGGA
AATATGAAGGACAATTGGAGAAGTGAATTATATAAATATAAAGTGGTAGAAGTTAAGCCATTAGGAGTAGCACCCAC
TAATGCAAGAAGGAGAGTGGTGGAGAGAGAAAAAAGAGCAGTGGGAATGGGAGCTGTGTTCCTTTGGGTTCTTGGGAG
CGGCAGGAAGCACTATGGGCGCAGCATCAATAACGCTGACGGTACAGGCCAGACAATTATTGTCTGGTATAGTGCAA
CAGCAAAGCAATTTGCTGAAGGCTATAGAGGCTCAACAGCATATGTTGAAACTCACGGTCTGGGGCATTAAACAGCT
CCAGGCAAGAGTCCTGGCCTTGGAAAGATACCTAAAGGATCAACAGCTCCTAGGGATGTGGGGCTGCTCTGGAAAAC
TCATCTGCACCACTAATGTATATTGGAACTCTAGTTGGAGTAATAAAACTTATGGTGATATTTGGGATAACATGACC
TGGATGCAGTGGGAGAGAGAAATTAGCAATTATACAGACCTAATATATGACTTGCTTGAAGAATCACAAAACCAGCA
GGAAAAGAATGAACAAGATTTATTAGCATTGGACAGATGGAACAGTCTGTGGAATTGGTTTAACATAACAAAATGGC
TGTGGTATATAAAATATTCATAATGATAGTAGGAGGCTTGATAGGTTTAAGAATAATTTTTGCTGTGCTTTCTTTA
GTAAATAGAGTTAGGCAGGGATACTCACCTCTGTCGTTGCAGACCCTTATCCCAAGCCCGAGGGGACCAGACAGGCC
CGGAGGAATCGAAGAAGAAGGTGGAGAGCAAGACAGAAACAGATCAACGCGATTAGTGAGCGGATTCTTAGCGCTTG
CCTGGGACGACCTGCGGAGCCTGTGCCTTTTCCTCTACCACCGATTGAGAGACTTCATATTAATTGCAGCGAGAGCG
GGGGAACTTCTGGGACGCAGCAGTCTCAAGGGACTACGGAGAGGGTGGGAAGCCCTTAAGTATCTGGGAGGTCTTGT
GCAGTATTGGGGCCTGGAACTAAAAAGGAGTGCTATTAGTCTATTGGATACCCTAGCAATAGCAGTAGGTGAAGGAA
CAGATAGGATTCTAGAATTTGTATTAGGAATTTGTAGAGCTATCCGCAACATACCTACAAGAATAAGACAGGGCTTT
GAAACAGCTTTGCTATAA
>703010505.W136.B26
ATGAGAGTGATGGGGATACAGAGGAATTGTCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGAATCAGATGCATGAAGA
TGTAATTAGTTTATGGGATCAAAGCCTCAAGCCATGTGTAAAGTTGACCCCACTCTGTGTCACTCTATACTGTACCA
ATGCTACTGCCAATGCTACTGTCAGCAATAGCAGTATAATAGAGGAAATGAAAAATTGCTCTTTCAATATAACCACA
GAATTAAGAGATAAGAGAGAGAAAAAGAATGCACTTTTTTATAAACTTGATATAGTACAACTAGATGGCAACTCTAG
TCAGTATAGATTAATAAATTGTAATACCTCAGCCATAACACAAGCCTGTCCAAAGGTCTCTTTTGACCCAATTCCTA
TACATTATTGTGCTCCAGCTGGTTATGCGATTCTAAAGTGTAATAATAAGACATTCAATGGAACAGGACCGTGTAAT
AATGTCAGCACAGTACAATGTACACATGGAATTAAGCCAGTGGTTTCAACTCAACTATTGTTAAATGGTAGCCTAGC
AGAAGGAGAGATAATAATTAGATCTGAAAATATAACAAACAGTGCCAAAACAATAATAGTACATCTCAATGAATCTG
TAAAGATTGAGTGTACGAGACCCAGTAATAACACAAGAACAAGTATAAGAATAGGACCAGGACAAGCATTTTATGCA
ACAGGACAAGTAATAGGAGACATAAGACAAGCACATTGTAACATTAGTGAAAGTAAATGGAATGAAACTTTACAAAG
GGTAAGTGAAAAATTAAAAGAATACTTCCCTGATAAGAATATAACATTTCAACCATCCTCAGGAGGGGACCCAGAAA
TTACAACACATAGCTTTAATTGTGGAGGAGAATTTTTCTATTGCAATACATCAAGCCTGTTTAATAGGACATACATG
GCTAATAGTACAGAAACTAACAGTACACGAACCATCACACTCCACTGCAGAATAAACAAATTATAAACATGTGGCA
GGAGGTGGGACGAGCAATGTATGCCCCTCCCATTGCAGGAAACATAACATGTATATCAAATATCACAGGACTACTAT
TGACAAGGGATGGAGGAGAAAACGATACGGAGACATTCAGACCTGTAGGAGGAAATATGAAGGACAATTGGAGAAGT
GAATTATATAAATATAAAGTGGTAGAAGTTAAGCCATTAGGAGTAGCACCCACTAAGGCAAGAAGGAGAGTGGTGGA
GAGAGAAAAAAGAGCAGTGGGAATGGGAGCTGTGTTCCTTGGGTTCTTGGGAGCGGCAGGAAGCACTATGGGCGCAG
CATCAATAACGCTGACGGTACAGGCCAGACAATTATTGTCTGGTATAGTGCAACAGCAAAGCAATTTGCTGAAGGCT
ATAGAGGCTCAACAGCATATGTTGAAACTCACGGTCTGGGGCATTAAACAGCTCCAGGCAAGAGTCCTGGCCTTGGA
AAGATACCTAAAGGATCAACAGCTCCTAGGGATGTGGGGCTGCTCTGGAAAACTCATCTGCACCACTAATGTATATT
GGAACTCTAGTTGGAGTAATAAAACTTATGGTGATATTTGGGATAACATGACCTGGATGCAGTGGGAGAGAGAAATT
AGCAATTATACAACATAATATATGACTTGCTTGAAGAATCACAAAACCAGCAGGAAAAGAATGAACAAGATTTACT
AGCATTGGACAGATGGAACAGTCTGTGGAATTGGTTTAACATAACAAAATGGCTGTGGTATATAAAATATTCATAA
TGATAGTAGGAGGCTTGATAGGTTTAAGAATAATTTTTGCTGTGCTTTCTTTAGTAAATAGAGTTAGGCAGGGATAC
TCACCTCTGTCATTGCAGACCCTTATCCCAAGCCCGAGGGGACCAGACAGGCCCGGAGGAATCGAAGAAGAAGGTGG
AGAGCAAGACAGAAACAGATCAACGCGATTAGTGAGCGGATTCTTAGCGCTTGCCTGGGACGACCTGCGGAGCCTGT
GCCTTTTCATCTACCACCGATTGAGAGACTTCATATTAATTGCAGCGAGAGCGGGGGAACTTCTGGGACGCAGCAGT
CTCAAGGGACTACGGAGAGGGTGGGAAGCCCTTAAGTATCTGGGAGGTATTGTGCAGTATTGGGGCCTGGAACTAAA
```

FIG. 17B cont'd

AAGGAGTGCTATTAGTCTATTGGATACCCTAGCAATAGCAGTAGGTGAAGGAACAGATAGGATTCTAGAATTTGTAT
TAGGAATTTGTAGAGCTATCCGCAACATACCTACAAGAATAAGACAGGGCTTTGAAACAGCTTTGCTATAA
>703010505.W136.B30
ATGAGAGTGAGGGGGATACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCACATGAGAAAGAAGTGCATAATGTCTGGGCTACACATGCCTGTGTACCCACAGACCCCAATCCA
CAAGAAATGGTTTTAAAAAAATGTAACAGAAAATTTCAACATGTGGGAAAATGACATGGTAGATCAGATGCATGAAGA
TGTAATTAGTTTATGGGATCAAAGCCTCAAGCCATGTGTAAAGTTGACCCCACTCTGTGTCACTCTATACTGTACCA
ATGCTACTGCCAATGCTACTGTCAGCAATAGCAGTATAATAGAGGAAATGAAAAATTGCTCTTTCAATATAACCACA
GAATTAAGAGATAAGAGAGAGAAAAAGTATGCACTTTTTTATAAACTTGATATAGTACAACTAGATGGCAACTCTAG
TGGCAACTCTAGTCAGTATAGATTAATAAAATTGTAATACCCTCAGCCATAACACAAGCCTGTCCAAAGGTCTCTTTTG
ACCCGAATTCCTATACATTATTGTGCTCCAGCTGGTTATGCGATTCTAAAGTGTAATAATAAGACATTCAATGGAACA
GGACCGTGTAATAATGTCAGCACAGTACAATGTACACATGGAATTAAGCCAGTGGTTTCAACTCAACTATTGTTAAA
TGGTAGCCTAGCAGAAGGAGAGATAATAATTAGATCTAAAAATATAACAGACAATGGCCAAACAATAATAGTACATC
TCAATGAATCTGTAAAGATTGAGTGTACGAGACCCAGTAATAACACAAGAACAAGTATAAGAATAGGACCAGGACAA
GCATTTTATGCAACAGGACAAGTAATAGGAGACATAAGAAAAGCACATTGTAACATTAGTGAAAGTAAATGGAATGA
AACTTTACAAAGGGTAAGTGAAAAATTAAAAGAATACTTCCCTAATAAGAATATAACATTTCAACCATCCTCAGGAG
GGGACCCAGAAATTACAACACATAGCTTTAATTGTGGAGGAGAATTTTTCTATTGCAATACATCAAGCCTGTTTAAT
AGGACATACATGGCTAATAGTACAGAAACTAACAGTACACGAACCATCACACTCCACTGCAGAATAAAACAAATTAT
AAACATGTGGCAGGAGGTGGGACGAGCAATGTATGCCCCTCCCATTGCAGGAAACATAACATGTATATCAAATATCA
CAGGACTACTATTGACAAGGGATGGAGGAAACAGCAGTAAGGAGACAGAGACATTCAGACCTGGAGGAGGAAATATG
AAGGACAATTGGAGAAGTGAATTATATAAATATAAAGTGGTAGAGGTTAAGCCATTAGGAGTAGCACCCACTAATGC
AAGAAGGAGAGTGGTGGAGAGAGAAAAAAGAGCGTGGGAATGGAGCTGTGTTCCTTGGGTTCTTGGGAGCGGCAG
GAAGCACTATGGGCGCAGCATCAATAACGCTGACGGTACAGGCCAGACAATTATTGTCTGGTATAGTGCAACAGCAA
AGCAATTTGCTGAAGGCTATAGAGGCTCAACAGCATATGTTGAGACTCACGGTCTGGGGCATTAAACAGCTCCAGGC
AAGAGTCCTGGCCTTGGAAAGATACCTAAAGGATCAACAGCTCCTAGGGATGTGGGGCTGCTCTGGAAAACTCATCT
GCACCACTAATGTATATTGGAACTCTAGTTGGAGTAATAAAACTTATGGTGATATTTGGAATAACATGACCTGGATG
CAGTGGGAGAGAGAAATTAGCAATTATACAGACATGATATATAATTTGCTTGAAGAATCACAAAACCAGCAGGAAAA
GAATGAACAAGATTTACTAGCATTGGACAGATGGAACAGTCTGTGGAATTGGTTTAACATAACAAAATGGCTGTGGT
ATATAAAAATATTCATAATGATAGTAGGAGGCTTGATAGGTTTAAGAATAATTTTTGCTGTGCTTTCTTTAGTAAAT
AGAGTTAGGCAGGGATACTCACCTCTGTCGTTGCAGACCCTTATCCCAAGCCCGAGGGGACCAGACAGGCCCGGAGG
AATCGAAGAAGAAGGTGGAGAGCAAGACAGAAAGAGATCAACGCGATTAGTGAGCGGATTCTTAGCGCTTGTCTGGG
ACGACCTGCGGAGCCTGTGCCTTTTCCTCTACCACCGATTGAGAGACTTCATATTAATTGCAGCGAGAGCGGGGAA
CTTCTGGGACGCAGCAGTCTCAAGGGACTACGGAGAGGGTGGGAAGCCCTTAAGTATCTGGGAAGTCTTGTGCAGTA
TTGGGGCCTGGAACTAAAAGGGAGTGCTATTAGTCTATTGGATACCCTAGCAATAGCAGTAGGTGAAGGAACAGATA
GGATTCTAGAATTTGTATTAGGAATTTGTAGAGCTATCCGCAACATACCCACAAGAATAAGACAGGGCTTTGAAACA
GCTTTGCTATAA
>703010505.W136.B7
ATGAGAGTGAGGGGGATACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAATGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTAATGATGCTAATGCTACTGCCAGCAATACCAATGCTACTGTCAGCAATAATAGCAGTATAATAGAGGAAATG
AAAAATTGCTCTTTCAATATAACCACAGAATTAAGAGATAAGATAGAGAAAAAGTATGCACTTTTTTATAAACTTGA
TATAGTACAACTAGATGGCAACTCTAGTCATTATAGATTCATAAATTGTAATACCCTCAGCCATAACACAAGCCTGTC
CAAAGGTCTCTTTTGACCCAATTCCTATACATTATTGTGCTCCAGCTGGTTATGCGATTCTAAAGTGTAATAATAAG
ACATTCAATGGAACAGGACCGTGTAATAATGTCAGCACAGTACAATGTACTCATGGAATTAAGCCAGTGGTTTCAAC
TCAACTATTGTTAAATGGTAGCCTAGCAGAAGGAGAGATAATAATTAGATCAGAAAATATAACAGACAATGGCAACA
CAATAATAGTACATCTCAATGAATCTGTAAAGATTGAGTGTACGAGACCCAGTAATAACACAAGAACAAGTATAAGA
ATAGGACCAGGACAAGCATTTTATGCAACAGGACAAGTAATAGGAGACATAAGACAAGCACATTGTAACATTAGTGA
AAGTAAATGGAATGAAACTTTACAAAGGGTAAGTGAAAAATTAAAAGAATACTTCCCTAATAAGACTATAACATTTC
AACCATCCTCAGGAGGGGACCCAGAAATTACAACACATAGCTTTAATTGTGGAGGAGAATTTTTCTATTGCAATACA
TCAAGCCTGTTTAATAGGACATACATGGCTAATAGTACAGAAACTAACAGTACACGAACCATCACACTCCACTGCAG
AATAAAACAAATTATAAACATGTGGCAGGAGGTGGGACGAGCAATGTATGCCCCTCCCATTGCAGGAAACATAACAT
GTATATCAAATATCACAGGACTACTATTGACAAGGGACGGAGGAAACACTACGGATATGGAGACATTCAGACCTGGA
GGAGGAAATATGAAGGACAATTGAGAAGTGAATTATATAAATATAAAGTGGTAGAAGTTAAGCCATTAGGAGTAGC
ACCCACTAATGCAAGAAGGAGAGTGGTGGAGAGAGAAAAAAGAGCAGTGGGAATGGGAGCTGTGTTCCTTGGGTTCT
TGGGAGCGGCAGGAAGCACTATGGGCGCAGCATCAATAACGCTGACGGTACAGGCCAGACAATTATTGTCTGGTATA
GTGCAACAGCAAAGCAATTTGCTGAAGGCTATAGAGGCTCAACAGCATATGTTGAAACTCACGGTCTGGGGCATTAA
ACAGCTCCAGGCAAGAGTCCTGGCCTTGGAAAGATACCTAAAGGATCAACAGCTCCTAGGGATGTGGGGCTGCTCTG
GAAAACTCATCTGCACCACTAATGTATATTGGAACTCTAGTTGGAGTAATAAAACTTATGATGATATTTGGGATAAC
ATGACCTAGATGCAGTGGGAGAGAGAAATTAGCAATTATACAGAAATAATATATGACTTGCTTGAAGAATCACAAAA
CCAGCAGGAAAAGAATGAACAAGATTTACTAGCATTGGACAGATGGAACAGTCTGTGGAATTGGTTTAACATAACAA
AATGGCTGTGGTATATAAAAATATTCATAATGATAGTAGGAGGCTTGATAGGTTTAAGAATAATTTTTGCTGTGCTT
TCTTTAGTAAATAGAGTTAGGCAGGGATACTCACCTCTGTCGTTGCAGACCCTTATCCCAAGCCCGAGGGGACCAGA
CAGGCCCGGAGGAATCGAAGAAGAAGGTGGAGAGCAAGACAGAAAGAGATCAACGCGATTAGTGAGCGGATTCTTAG
CGCTTGCCTGGGACGACCTGCGGAGCCTGTGCCTTTTCATCTACCACCGATTGAGAGACTTCATATTAATTGCAGCG
AGAGCGGGGAACTTCTGGGACGCAGCAGTCTCAAGGGACTACGAGAGGGTGGGAAGCCCTTAAGTATCTGGGAGG
TCTTGTGCAGTATTGGGGCCTGGAACTAAAAAAGAGTGCTATTAGTCTATTGGATACCCTAGCAATAGCAGTAGGTG

FIG. 17B cont'd

```
AAGGAACAGATAGGATTCTAGAATTTGTATTAGGAATTTGTAGAGCTATCCGCAACATACCTACAAGAATAAGACAG
GGCTTTGAAACAGCTTTGCTATAA
>703010505.W136.B2
ATGAGAGTGAGGGGGATACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGCGCATAATGTCTGGGCTACACATGCCTGTGTACCCACAGACCCCAATCCA
CAAGAAATGGTTTTAAAAAATGTAACAGAAAATTTCAACATGTGGGAAAATGACATGGTAGATCAGATGCATGAAGA
TGTAATTAGTTTATGGGATCAAAGCCTCAAGCCATGTGTAAAGTTGACCCCACTCTGTGTCACTCTAAACTGTACCG
ATGCTAATGCTACTGCCAGCAATACCAATGCTACTGTCAGCAATATCAAGGCTACTGTCAGCAATAGCAGTATAATA
GAGGAAATGAAAAATTGCTCTTTCAATATAACCACAGAATTAAGAGATAAGATAGAGAAAAAGTATGCACTTTTTTA
TAAACTTGATATAGTACAACTAGATGGCAACTCTACTCAGTATAGATTCATAAATTGTAATACCTCAGCCATAACAC
AAGCCTGTCCAAAGGTCTCTTTTGACCCAATTCCTATACATTATTGTGCTCCAGCTGGTTATGCGATTCTAAAGTGT
AATAATAAGACATTCAATGGAACAGGACCGTGTAATAATGTCAGCACAGTACAATGTACACATGGAATTAAGCCAGT
GGTTTCAACTCAACTATTGTTAAATGGTAGCCTAGCAGAAGGAGAGATAATAATTAGATCTGAAAATATAACAGACA
ATGGCAAAACAATAATAGTACATCTCAATGAATCTGTAAAGATTGAGTGTACGAGACCCGGCAATAACACAAGAACA
AGTATAAGAATAGGACCAGGACAAGCATTTTATGCAACAGGACAAGTAATAGGAGACATAAGACAAGCACATTGTAA
CATTAGTGAAAGTAAATGGAATGAAACTTTACAAAGGGTAAGTGAAAAATTAAAAGAATACTTCCCTAATAAGACTA
TAACATTTCAACCATCCTCAGGAGGGGACCCAGAAATTACAACACATAGCTTTAATTGTGGAGGAGAATTTTTTTAT
TGCAATACATCAAGCCTGTTTAATAGGACATACATGGCTAATAGTACAGAAACTAACAGTACACGAACCATCACACT
CCACTGCAGAATAAAACAAATTATAAACATGTGGCAGGAGGTGGGACGAGCAATGTATGCCCCTCCCATTGCAGGAA
ACATAACATGTATATCAAATATCACAGGACTACTATTGACAAGGGATGGAGGAAACACTACGGATATAGAGACATTC
AGACCTGGAGGAGGAAATATGAAGGACAATTGGAGAAGTGAATTATATAAATATAAAGTGGTAGAAGTTAAGCCATT
AGGAGTAGCACCCACTAAGGCAAGAAGGAGAGTGGTGGAGAGAGAAAAAAGAGCAGTGGGAATGGGAGCTGTGTTCC
TTGGGTTCTTGGGAGCGGCAGGAAGCACTATGGGCGCAGCATCGATAACGCTGACGGTACAGGCCAGACAATTATTG
TCTGGTATAGTGCAACAGCAAAGCAATTTGCTGAAGGCTATAGAGGCTCAACAGCATATGTTGAAACTCACGGTCTG
GGGCATTAAACAGCTCCAGGCAAGAGTCCTGGCCTTGGAAAGATACCTAAAGGATCAACAGCTCCTAGGGATGTGGG
GCTGCTCTGGAAAACTCATCTGCACCCACTAATGTATATTGGAACTCTAGTTGGAGTAATAAAACTTATGATGATATT
TGGGATAACATGACCTGGATGCAGTGGGACAGAGAAATTAGCAATTACACAGAAATAATATATGACTTGCTTGAAGA
ATCACAAAACCAGCAGGAAAAGAATGAACAAGATTTACTAGCATTGGACAGGTGGAACAGTCTGTGGAATTGGTTTA
ACATAACAAAATGGCTGTGGTATATAAAAATATTCATAATGATAGTAGGAGGCTTGATAGGTTTAAGAATAATTTTT
GCTGTGCTTTCTTTAGTAAATAGAGTTAGGCAGGGATACTCACCTCTGTCGTTGCAGACCCTTATCCCAAGCCCGAG
GGGACCAGACAGGCCCGGAGGAATCGAAGAAGAAGGTGGAGAGCAAGACAGATCAACGCGATTAGTGAGCG
GATTCTTAGCGCTTGCCTGGGACGACCTGCGGAGCCTGTGCCTTTTCATCTACCACCGATTGAGAGACTTCATATTA
ATTGCAGCGAGAGCGGGGGAACTTCTGGGACGCAGCAGTCTCAAGGGACTACGGAGAGGGTGGGAAGCCCTTAAGTA
TCTGGGAGGTATTGTGCAGTATTGGGGCCTGGAACTAAAAAGGAGTGCTATTAGTCTATTGGATACCCTAGCAATAG
CAGTAGGTGAAGGAACAGATAGGATTCTAGAATTTGTATTAGGAATTTGTAGAGCTATCCGCAACATACCTACAAGA
ATAAGACAGGGCTTTGAAACAGCTTTGCTATAA
>703010505.W136.B3
ATGAGAGTGAGGGGGATACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGCGCATAATGTCTGGGCTACACATGCCTGTGTACCCACAGACCCCAATCCA
CAAGAAATGGTTTTAAAAAATGTAACAGAAAATTTCAACATGTGGAAAATGACATGGTAGATCAGATGCATGAAGA
TGTAATTAGTTTATGGGATCAAAGCCTCAAGCCATGTGTAAAGTTGACCCCACTCTGTGTCACTCTAAACTGTACCG
ATGCTAATGCTACTGCCAGCAATGCTAATGCTACTGCCAGCAATACCAATGCTACTGTCAGCAATGATAGCAGTATA
ATAGAGGAAATGAAAAATTGCTCTTTCAATATAACCACAGAATTAAGAGATAAGATAGAGAAAAAGTATGCACTTTT
TTATAAACTTGATATAGTACAACTAGATGGCAACTCTACTCAGTATAGATTCATAAATTGTAATACCTCAGCCATAA
CACAAGCCTGTCCAAAGGTCTCTTTTGACCCAATTCCTATACATTATTGTGCTCCAGCTGGTTATGCGATTCTAAAG
TGTAATAATAAGACATTCAATGGAACAGGACCGTGTAATAATGTCAGCACAGTACAATGTACACATGGAATTAAGCC
AGTGGTTTCAACTCAACTATTGTTAAATGGTAGCCTAGCAGAAGGAGAGATAATAATTAGATCTAAAAACATAACAG
ACAATGGCAACACAATAATAGTACATCTCAATGAATCTGTAAAGATTGAGTGTACGAGACCCAGTAATAACACAAGA
ACAAGTATAAGAATAGGACCAGGACAAGCATTTTATGCAACAGGACAAGTAATAGGAGACATAAGACAAGCACATTG
TAACATTAGTGAAAGTAAATGGAATGAAACTTTACAAAGGGTAAGTGAAAAATTAAAAGAATACTTCCCTGATAAGA
ATACAGATTTCAACCATCCTCAGGAGGGGACCCAGAAATTACAACACATAGCTTTAATTGTGGAGGAGAATTTTTTT
TATTGCAATACATCAAGCCTGTTTAATAGGACATACATGGCTAATAGTACAGAAACTAACAGTACACGAACCATCAC
ACTCCACTGCAGAATAAAACAAATTATAAACATGTGGCAAGAGGTGGGACGAGCAATGTATGCCCCTCCCATTGCAG
GAAACATAACATGTATATCAAATATCACAGGACTACTATTGACAAGGGATGGAGGAAACAGCAGTAAGGAGACAGAG
ACATTCAGACCTGGAGGAGGAAATATGAAGGACAATTGGAGAAGTGAATTATATAAATATAAAGTGGTAGAAGTTAA
GCCATTAGGAGTAGCACCCACTAATGCAAGAAGGAGAGTGGTGGAGAGAGAAAAAAGAGCAGTGGGAATGGGAGCTG
TGTTCCTTGGGTTCTTGGGAGCGGCAGGAAGCACTATGGGCGCAGCATCAATAACGCTGACGGTACAGGCCAGACAA
TTATTGTCTGGTATAGTGCAACAGCAAAGCAATTTGCTGAAGGCTATAGAGGCTCAACAGCATATGTTGAGACTCAC
GGTCTGGGGCATTAAACAGCTCCAGGCAAGAGTCCTGGCCTTGGAAAGATACCTAAAGGATCAACAGCTCCTAGGGA
TGTGGGGCTGCTCTGGAAAACTCATCTGCACCCACTAATGTATATTGGAACTCTAGTTGGAGTAATAAAACTTATAGT
GATATTTGGGATAACATGACCTGGATGCAGTGGGACAGAGAAATTAGCAATTACACAGAAATAATATATAACTTGCT
TGAAGAATCACAAAACCAGCAGGAAAAGAATGAACAAGATTTACTAGCATTGGACAGATGGAACAGTCTGTGGAATT
GGTTTAACATAACAAAGTGGCTGTGGTATATAAAATATTCATAATGATAGTAGGAGGCTTGATAGGTTTAAGAATA
ATTTTTGCTGTGCTTTCTTTAGTAAATAGAGTTAGGCAGGGATACTCACCTCTGTCGTTGCAGACCCTTATCCCAAG
CCCGAGGGGACCAGACAGGCCCGGAGGAATCGAAGAAGAAGGTGGAGAGCAAGACAGAAAGAGATCAACGCGATTAG
TGAGCGGATTCTTAGCGCTTGTCTGGGACGACCTGCGGAGCCTGTGCCTTTTCCTCTACCACCGATTGAGAGACTTC
ATATTAATTGCAGCGAGAGCGGGGGAACTTCTGGGACGCAGCAGTCTCAAGGGACTACGGAGAGGGTGGGAAGCCCT
TAAGTATCTGGGAAGTCTTGTGCAGTATTGGGGCCTGGAACTAAAAGGGAGTGCTATTAGTCTATTGGATACCCTAG
```

FIG. 17B cont'd

CAATAGCAGTAGGTGAAGGAACAGATAGGATTCTAGAATTTGTATTAGGAATTTGTAGAGCTATCCGCAACATACCC
ACAAGAATAAGACAGGGCTTTGAAACAGCTTTGCTATAA
>703010505.W136.B24
ATGAGAGTGATGGGGAGACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAATGACATGGTAGATCAGATGCATGAAGA
TGTAATTAGTCTATGGGATCAAAGCCTCACGCCATGTGTAAAGTTGACCCCACTCTGTGTCACTCTAACCTGTACCG
ATGCTAATGCTACTGCCAGTAATGCTACTGCCAGCAATACCAATGCTACTGCCAGCAATAGCAGTATAATGATAGAG
GAAATGAAAAATTGCTCTTTTCAATATAACCACAGAATTAAGAGATAAGAGAGAGAAAAAGTATGCACTTTTTTATAA
ACTTGATATAGTACAACTAGATGGCAACTCTAGTCAGTATAGATTAATAAATTGTAATACCTCAGTCATAACACAAG
CCTGTCCAAAGGTCTCTTTTGACCCAATTCCTATACATTATTGTGCTCCAGCTGGTTATGCGATTCTAAAGTGTAAT
AATAAGACATTCAATGGAACAGGACCGTGTAATAATGTCAGCACAGTACAATGTACACATGGAATTAAGCCAGTGGT
TTCAACTCAACTATTGTTAAATGGTAGCCTAGCAGAAGGAGAGATAATAATTAGATCTGAAAATATAACAGACAATG
CCAAAACAATAATAGTACATCTCAATGAATCTGTAAAGATTGAGTGTACGAGACCCAGTAATAACACAAGAACAAGT
ATAAGAATAGGACCAGGACAAGCATTTTATGCAACAGGACAAGTAATAGGAGACATAAGAAAAGCACATTGTAACAT
TAGTGAAAGTAAATGGAGTGAAACTTTACAAAGGGTAAGTAAAAAATTAAAAGAATACTTCCCTGATAAGAATATAA
CATTTCAACCATCCTCAGGAGGGGACCCAGAAATTACAACACATAGCTTTAATTGTGGAGGAGAATTTTTCTATTGC
AATACATCAAGCCTGTTTAATAGGACAGATATGGCTAATAGTACAGAAACTAACAGTACACGAATCATCACACTCCA
CTGCAGAATAAAACAAATTATAAACATGTGGCAAGAGGTGGGACGAGCAATGTATGCCCCTCCCATTGCAGGAAACA
TAACATGTATATCAAATATCACAGGACTACTATTGACAAGGGATGGAGGAAACAGCAGTAAGGAGACAGAGACATTC
AGACCTGGAGGAGGAAATATGAAGGATAATTGGAGAAGTGAATTATATAAATATAAAGTGGTAGAAGTTAAGCCATT
AGGAGTAGCACCCACTAATGCAAGAAGGAGAGTGGTGGAGAGAGAAAAAAGAGCAGTGGGAATGGGAGCTGTGTTCC
TTGGGTTCTTGGGAGCGGCAGGAAGCACTATGGGCGCAGCATCAATAACGCTGACGGTACAGGCCAGACAATTATTG
TCTGGTATAGTGCAACAGCAAAGCAATTTGCTGAAGGCTATAGAGGCTCAACAGCATATGTTGAAACTCACGGTCTG
GGGCATTAAACAGCTCCAGGCAAGAGTCCTGGCCTTGGAAAGATACCTAAAGGATCAACAGCTCCTAGGGATGTGGG
GCTGCTCTGGAAAACTCATCTGCACCACTAATGTATATTGGAGTCCTAGTTGGAGTAATAAAACTTATAGTGATATT
TGGGATAACATGACCTGGATGCAGTGGGAGAAAGAAATTAGCAATTATACAGAAATGATATATGACTTGCTTGAAGA
ATCACAAAACCAGCAGGAAAAGAATGAACAAGATTTACTAGCATTGGACAGATGGAACAGTCTGTGGAATTGGTTTA
ACATAACAAAATGGCTGTGGTATATAAAAATATTCATAATGATAGTAGGAGGCTTGATAGGTTTAAGAATAATTTTT
GCTGTGCTTTCTTTAGTAAATAGAGTTAGGCAGGGATACTCACCTCTGTCGTTGCAGACCCTTATCCCAAGCCCGAG
GGGACCAGACAGGCCCGGAGGAATCGAAGAAGAAGGTGGAGAGCAAGACAGAAAGAGATCAACGCGATTAGTGAGCG
GATTCTTAGCGCTTGTCTGGGACGACCTGCGGAGCCTGTGCCTTTTCCTCTACCACCGATTGAGAGACTTCATATTA
ATTGCAGCGAGAGCGGGGAACTTCTGGGACGCAGCAGTCTCAAGGGACTACGGAGAGGGTGGGAAGCCCTTAAGTA
TCTGGGAAGTCTTGTGCAGTATTGGAGCCTGGAACTAAAAAGGAGTGCTATTAGTCTATTGGATACCCTAGCAATAG
CAGTAGGTGAAGGAACAGATAGGATTCTAGAATTTGTATTAGGAATTTGTAGAGCTATCCGCAACATACCTACAAGA
ATAAGACAGGGCTTTGAAACAGCTTTGCTATAA
>703010505.W136.B23
ATGAGAGTGATGGGGAGACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAATGACATGGTGGATCAGATGCATGAAGA
TGTAATTAGTTTATGGGATCAAAGCCTCACGCCATGTGTAAAGTTGACCCCACTCTGTGTCACTCTAAACTGTACTG
ATGCTAATGATACTGCCAGCAATAGCAGTATAATAAAGGGAATGAATAACAGTATAGTAGGGGAAATGAAAAATTGC
TCTTTCAATATAACCACAGAATTAAGAGATAAGAGAGAGAAAAAGAATGCACTTTTTTATAAACTTGATATAGTACA
ACTAGATGGCAACTCTAGTGAGTATAGATTAATAAATTGTAATACCTCAGTCATAACACAAGCCTGTCCAAAGGTCT
CTTTTGACCCAATTCCTATACATTATTGTGCTCCAGCTGGTTATGCGATTCTAAAGTGTAATAATAAGACATTCAAT
GGAACAGGACCGTGTAATAATGTCAGCACAGTACAATGTACACATGGAATTAAGCCAGTGGTTTCAACTCAACTATT
GTTAAATGGTAGCCTAGCAGAAGGAGAGATAATAATTAGATCTGAAAATATAACAGACAATGCCAAAACAATAATAG
TACATCTCAATGAATCTGTAAAGATTGAGTGTACGAGACCCAGTAATAACACAAGAACAAGTATAAGAATAGGACCA
GGACAAGCATTTTATGCAACAGGACAAGTAATAGGAGACATAAGAAAAGCACATTGTAACATTAGTGAAAGTAAATG
GAATGAAACTTTACAAAGGGTAAGTAAAAAATTAAAAGAATACTTCCCTGATAAGAATATAACATTTCAACCATCCT
CAGGAGGGGACCCAGAAATTACAACACATAGCTTTAATTGTGGAGGAGAATTTTTCTATTGCAATACATCAAGCCTG
TTTAATAGGACATATATGGCTAATAGTACAGATATGGCTAATAGTACAGAAACTAACAGTACAAGAACCATCACACT
CCACTGCAGAATAAAACAAATTATAAACATGTGGCAAGAGGTGGGACGAGCAATGTATGCCCCTCCCATTGCAGGAA
ACATAACATGTATATCAAATATCACAGGACTACTATTGACAAGGGATGGAGGAAACAGCAGTACGGAGACAGAGACA
TTCAGACCTGGAGGAGGAAATATGAAGGACAATTGGAGAAGTGAATTATATAAATATAAAGTGGTAGAAGTTAAGCC
ATTAGGAGTAGCACCCACTAATGCAAGAAGGAGAGTGGTGGAGAGAGAAAAAAGAGCAGTGGGAATGGGAGCTGTGT
TCCTTGGGTTCTTGGGAGCGGCAGGAAGCACTATGGGCGCAGCATCAATAACGCTGACGGTACAGGCCAGACAATTA
TTGTCTGGCATAGTGCAACAGCAAAGCAATTTGCTGAAGGCTATAGAGGCTCAACAGCATATGTTGAGACTCACGGT
CTGGGGCATTAAACAGCTCCAGGCAAGAGTCCTGGCCTTGGAAAGATACCTAAAGGATCAACAGCTCCTAGGGATGT
GGGGCTGCTCTGGAAAACTCATCTGCACCACTAATGTATATTGGAACTCTAGTTGGAGTAATAAAACTTATGATGAT
ATTTGGGATAACATGACCTGGATGCAGTGGGAGGGAGAAATTAGCAATTATACAAACATAATATATGACTTGCTTGA
AGAATCACAAAACCAGCAGGAAAAGAATGAACAAGATTTACTAGCATTGGACAGATGGAACAGTCTGTGGAATTGGT
TTAACATAACAAATTGGCTGTGGTATATAAAAATATTCATAATGATAGTAGGAGGCTTGATAGGTTTAAGAATAATT
TTTGCTGTGCTTTCTTTAGTAAATAGAGTTAGGCAGGGATACTCACCTCTGTCGTTGCAGACCCTTATCCCAAGCCC
GAGGGGACCAGACAGGCCCGGAGGAATCGAAGAAGAAGGTGGAGAGCAAGACAGAAAGAGATCAACGCGATTAGTGA
GCGGATTCTTAGCGCTTGTCTGGGACGACCTGCGGAGCCTGTGCCTTTTCCTCTACCACCGATTGAGAGACTTCATA
TTAATTGCAGCGAGAGCGGGGAACTTCTGGGACGCAGCAGTCTCAAGGGACTACGGAGAGGGTGGGAAGCCCTTAA
GTATCTGGGAAGTCTTGTGCAGTATTGGGGCCTGGAACTAAAAACGAGTGCTATTAGTCTATTGGATACCCTAGCAA

FIG. 17B cont'd

```
TAGCAGTAGGTGAAGGAACAGATAGGATTCTAGAATTTGTATTAGGAATTTGTAGAGCTATCCGCAACATACCTACA
AGAATAAGACAGGGCTTTGAAACAGCTTTGCTATAA
>703010505.W136.B18
ATGAGAGTGATGGGGAGACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCACGCCATGTGTAAAGTTGACCCCACTCTGTGTCACTCTAAACTGTACCG
ATGCTAATGATACTGCCAGCAATAGCAGTATAATAAAGGGAATGAATAACAGTATAGTAGGGGAAATGAAAAATTGC
TCTTTCAATATAACCACAGAATTAAGAGATAAGAGAGAGAAAAAGAATGCACTTTTTTATAAACTTGATATAGTACA
ACTAGATGGCAACTCTAGTGAGTATAGATTAATAAATTGTAATACCTCAGTCATAACACAAGCCTGTCCAAAGGTCT
CTTTTGACCCAATTCCTATACATTATTGTGCTCCAGCTGGTTATGCGATTCTAAAGTGTAATAATAAGACATTCAAT
GGAACAGGACCGTGTAATAATGTCAGCACAGTACAATGTACACATGAATTAAGCCAGTGGTTTCAACTCAACTATT
GTTAAATGGTAGCCTAGCAGAAGGAGAGATAATAATTAGATCTGAAAATATAACAGACAATGCCAAAACAATAATAG
TACATCTCAATGAATCTGTAAAGATTGAGTGTACGAGACCCAGTAATAACACAAGAACAAGTATAAGAATAGGACCA
GGACAAGCATTTTATGCAACAGGACAAGTAATAGGAGACATAAGAAAAGCACATTGTAACATTAGTGAAAGTAAATG
GAATGAAACTTTACAAAGGGTAAGTAAAAAAATTAAAAGAATACTTCCCTGATAAGAATATAACATTTCAACCATCCT
CAGGAGGGGACCCAGAAATTACAACACATAGCTTTAATTGTGGAGGAGAATTTTTCTATTGCAATACATCAAGCCTG
TTTAATAGGACATATATGGCTAATAGTACAGATATGGCTAATAGTGCAGAAACTAACAGTACAAGAACCATCACACT
CCACTGCAGAATAAAACAAATTATAAACATGTGGCAGGAGGTGGGACGAGCAATGTATGCCCCTCCCATTGCAGGAA
ACATAACATGTATATCAAATATCACAGGACTACTATTGACAAGGGATGGAGGAAACAGCAGTACGGAGACAGAGACA
TTCAGACCTGGAGGAGGAAATATGAAGGACAATTGGAGAAGTGAATTATATAAATATAAAGTGGTAGAAGTTAAGCC
ATTAGGAGTAGCACCCACTAATGCAAGAAGGAGAGTGGTGGAGAGAGAAAAAAGAGCAGTGGGAATGGGAGCTGTGT
TCCTTGGGTTCTTGGGAGCGGCAGGAAGCACTATGGGCGCAGCATCAATAACGCTGACGGTACAGGCCAGACAATTA
TTGTCTGGCATAGTGCAACAGCAAAGCAATTTGCTGAAGGCTATAGAGGCTCAACAGCATATGTTGAGACTCACGGT
CTGGGGCATTAAACAGCTCCAGGCAAGAGTCCTGGCCTTGGAAAGATACCTAAAGGATCAACAGCTCCTAGGGATGT
GGGGCTGCTCTGGAAAACTCATCTGCACCACTAATGTATATTGGAACTCTAGTTGGAGTAATAAAACTTATGATGAT
ATTTGGGATAACATGACCTGGATGCAGTGGGAGGGAGAAATTAGCAATTATACAAACATAATATATGACTTGCTTGA
AGAATCACAAAACCAGCAGGAAAAGAATGAACAAGATTTACTAGCATTGGACAGATGGAACAGTCTGTGGAATTGGT
TTAACATAACAAATTGGCTGTGGTATATAAAAATATTCATAATGATAGTAGGAGGCTTGATAGGTTTAAGAATAATT
TTTGCTGTGCTTTCTTTAGTAAATAGAGTTAGGCAGGGATACTCACCTCTGTCGTTGCAGACCCTTATCCCAAGCCC
GAGGGGACCAGACAGGCCCGGAGGAATCGAAGAAGAAGGTGGAGAGCAAGACAGAAAGAGATCAACGCGATTAGTGA
GCGGATTCTTAGCGCTTGTCTGGGACGACCTGCGGAGCCTGTGCCTTTTCCTCTACCACCGATTGAGAGACTTCATA
TTAATTGCAGCGAGAGCGGGGGAACTTCTGGGACGCAGCAGTCTCAAGGGACTACGGAGAGGGTGGGAAGCCCTTAA
GTATCTGGGAAGTCTTGTGCAGTATTGGGGCCTGGAACTAAAAAGGAGTGCTATTAGTCTATTGGATACCCTAGCAA
TAGCAGTAGGTGAAGGAACAGATAGGATTCTAGAATTTGTATTAGGAATTTGTAGAGCTATCCGCAACATACCTACA
AGAATAAGACAGGGCTTTGAAACAGCTTTGCTATAA
>703010505.W136.B33
ATGAGAGTGATGGGGAGACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCACGCCATGTGTAAAGTTGACCCCACTCTGTGTCACTCTAAACTGTACCG
ATGCTAATGATACTGCCAGCAATAGCAGTATAATAAAGGGAATGAATAACAGTATAGTAGGGGAAATGAAAAATTGC
TCTTTCAATATAACCACAGAATTAAGAGATAAGAGAGAGAAAAAGAATGCACTTTTTTATAAACTTGATATAGTACA
ACTAGATGGCAACTCTAGTGAGTATAGATTAATAAATTGTAATACCTCAGTCATAACACAAGCCTGTCCAAAGGTCT
CTTTTGACCCAATTCCTATACATTATTGTGCTCCAGCTGGTTATGCGATTCTAAAGTGTAATAATAAGACATTCAAT
GGAACAGGACCGTGTAATAATGTCAGCACAGTACAATGTACACATGAATTAAGCCAGTGGTTTCAACTCAACTATT
GTTAAATGGTAGCCTAGCAGAAGGAGAGATAATAATTAGATCTGAAAATATAACAGACAATGCCAAAACAATAATAG
TACATCTCAATGAATCTGTAAAGATTGAGTGTACGAGACCCAGTAATAACACAAGAACAAGTATAAGAATAGGACCA
GGACAAGCATTTTATGCAACAGGACAAGTAATAGGAGACATAAGAAAAGCACATTGTAACATTAGTGAAAGTAAATG
GAATGAAACTTTACAAAGGGTAAGTAAAAAAATTAAAAGAATACTTCCCTGATAAGAATATAACATTTCAACCATCCT
CAGGAGGGGACCCAGAAATTACAACACATAGCTTTAATTGTGGAGGAGAATTTTTCTATTGCAATACATCAAGCCTG
TTTAATAGGACATATATGGCTAATAGTACAGATATGGCTAATAGTGCAGAAACTAACAGTACAAGAACCATCACACT
CCACTGCAGAATAAAACAAATTATAAACATGTGGCAGGAGGTGGGACGAGCAATGTATGCCCCTCCCATTGCAGGAA
ACATAACATGTATATCAAATATCACAGGACTACTATTGACAAGGGATGGAGGAAACAGCAGTACGGAGACAGAGACA
TTCAGACCTGGAGGAGGAAATATGAAGGACAATTGGAGAAGTGAATTATATAAATATAAAGTGGTAGAAGTTAAGCC
ATTAGGAGTAGCACCCACTAATGCAAGAAGGAGAGTGGTGGAGAGAGAAAAAAGAGCAGTGGGAATGGGAGCTGTGT
TCCTTGGGTTCTTGGGAGCGGCAGGAAGCACTATGGGCGCAGCATCAATAACGCTGACGGTACAGGCCAGACAATTA
TTGTCTGGCATAGTGCAACAGCAAAGCAATTTGCTGAAGGCTATAGAGGCTCAACAGCATATGTTGAGACTCACGGT
CTGGGGCATTAAACAGCTCCAGGCAAGAGTCCTGGCCTTGGAAAGATACCTAAAGGATCAACAGCTCCTAGGGATGT
GGGGCTGCTCTGGAAAACTCATCTGCACCACTAATGTATATTGGAACTCTAGTTGGAGTAATAAAACTTATGGTGAT
ATTTGGGATAACATGACCTGGATGCAGTGGGAGAGCGAAATTAGCAATTATACAAACATAATATATGATTTGCTTGA
AGAATCACAAAACCAGCAGGAAAAGAATGAACAAGATTTACTAGCATTGGACAGATGGAACAGTCTGTGGAATTGGT
TTAACATAACAAATTGGCTGTGGTATATAAAAATATTCATAATGATAGTAGGAGGCTTGATAGGTTTAAGAATAATT
TTTGCTGTACTTTCTTTAGTAAATAGAGTTAGGCAGGGATACTCACCTCTGTCGTTGCAGACCCTTATCCCAAGCCC
GAGGGGACCAGACAGGCCCGGAGGAATCGAAGAAGAAGGTGGAGAGCAAGACAGAAAGAGATCAACGCGATTAGTGA
GCGGATTCTTAGCGCTTGTCTGGGACGACCTGCGGAGCCTGTGCCTTTTCCTCTACCACCGATTGAGAGACTTCATA
TTAATTGCAGCGAGAGCGGGGGAACTTCTGGGACGCAGCAGTCTCAAGGGACTACGGAGAGGGTGGGAAGCCCTTAA
GTATCTGGGAAGTCTTGTGCAGTATTGGGGCCTGGAACTAAAAAGGGAGTGCTATTAGTCTATTGGATACCCTAGCAA
```

FIG. 17B cont'd

TAGCAGTAGGTGAAGGAACAGATAGGATTCTAGAATTTGTATTAGGAATTTGTAGAGCTATCCGCAACATACCCACA
AGAATAAGACAGGGCTTTGAAACAGCTTTGCTATAA
>703010505.W136.B38
ATGAGAGTGATGGGGAGACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCACGCCATGTGTAAAGTTGACCCCACTCTGTGTCACTCTAAACTGTACCG
ATGCTAATGATACTGCCAGCAATAGCAGTATAATAAAGGGAATGAATAACAGTATAGTAGGGGAAATGAAAAATTGC
TCTTTCAATATAACCACAGAATTAAGAGATAAGAGAGAGAAAAAGAATGCACTTTTTTATAAACTTGATATAGTACA
ACTAGATGGCAACTCTAGTGAGTATAGATTAATAAATTGTAATACCTCAGTCATAACACAAGCCTGTCCAAAGGTCT
CTTTTGACCCAATTCCTATACATTATTGTGCTCCAGCTGGTTATGCGATTCTAAAGTGTAATAATAAGACATTCAAT
GGAACAGGACCGTGTAATAATGTCAGCACAGTACAATGTACACATGGAATTAAGCCAGTGGTTTCAACTCAACTATT
GTTAAATGGTAGCCTAGCAGAAGGAGAGATAATAATTAGATCTGAAAATATAACAGACAATGCCAAAACAATAATAG
TACATCTCAATGAATCTGTAAAGATTGAGTGTACAGACCCAGTAATAACACAAGACAAGTATAAGAATAGGACCA
GGACAAGCATTTTATGCAACAGGACAAGTAATAGGAGACATAAGAAAAGCACATTGTAACATTAGTGAAAGTAAATG
GAATGAAACTTTACAAAGGGTAAGTAAAAAATTAAAAGAATACTTCCCTGATAAGAATATAACATTTCAACCATCCT
CAGGAGGGGACCCAGAAATTACAACACATAGCTTTAATTGTGGAGGAGAATTTTTCTATTGCAATACATCAAGCCTG
TTTAATAGGACATATATGGCTAATAGTACAGATATGGCTAATAGTGCAGAAACTAACAGTACAAGAACCATCACACT
CCACTGCAGAATAAAACAAATTATAAACATGTGGCAGGAGGTAGGACAAGCGGCAATGTATGCCCCTCCCATTGCAGGAA
ACATAACATGTATATCAAATATCACAGGACTACTATTGACAGGGATGGAGGAAACAGCAGTACGGAGGACAGAGACA
TTCAGACCTGGAGGAGGAAATATGAAGGACAATTGGAGAAGTGAATTATATAAATATAAAGTGGTAGAAGTTAAGCC
ATTAGGAATAGCACCCACTAATGCAAGAAGGAGAGTGGTGGAGAGAGAAAAAGAGCAGTGGGAATGGGAGCTGTGT
TCCTTGGGTTCTTGGGAGCGGCAGGAAGCACTATGGGCGCAGCATCAATAACGCTGACGGTACAGGCCAGACAATTA
TTGTCTGGCATAGTGCAACAGCAAAGCAATTTGCTGAAGGCTATAGAGGCTCAACAGCATATGTTGAGACTCACGGT
CTGGGGCATTAAACAGCTCCAGGCAAGAGTCCTGGCCTTGGAAAGATACCTAAAGGATCAACAGCTCCTAGGGATGT
GGGGCTGCTCTGGAAAACTCATCTGCACCACTAATGTATATTGGAACTCTAGTTGGAGTAATAAAACTTATGGTGAT
ATTTGGGATAACATGACCTGGATGCAGTGGGAGAAGCGAAATTAGCAATTATACAAACATAATATATGATTTGCTTGA
AGAATCACAAAACCAGCAGGAAAAGAATGAACAAGATTTACTAGCATTGGACAGATGGAACAGTCTGTGGAATTGGT
TTAACATAACAAAATGGCTGTGGTATATAAAAATATTCATAATGATAGTAGGAGGCTTGATAGGTTTAAGAATAATT
TTTGCTGTACTTTCTTTAGTAAATAGAGTTAGGCAGGGATACTCACCTCTGTCGTTGCAGACCCTTATCCCAAGCCC
GAGGGGACCAGACAGGCCCGGAGGAATCGAAGAAGAAGGTGGAGAGCAAGACAGAAAGAGATCAACGCGATTAGTGA
GCGGATTCTTAGCGCTTGTCTGGGACGACCTGCGGAGCCTGTGCCTTTTCCTCTACCACCGATTGAGAGACTTCATA
TTAATTGCAGCGAGAGCGGGGAACTTCTGGGACGCAGCAGTCTCAAGGGACTACGGAGAGGGTGGGAAGCCCTTAA
GTATCTGGGAAGTCTTGTGCAGTATTGGGGCCTGGAACTAAAAGGGAGTGCTATTAGTCTATTGGATACCCTAGCAA
TAGCAGTAGGTGAAGGAACAGATAGGATTCTAGAATTTGTATTAGGAATTTGTAGAGCTATCCGCAACATACCCACA
AGAATAAGACAGGGCTTTGAAACAGCTTTGCTATAA
>703010505.W160.A1
ATGAGAGTGAGGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGACAGCAAAAGCAATATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAACTC
TAGTCAGTATAGATTAATAAATTGTAATACCTCAGTCATAACACAAGCCTGTCCTTTTGACCCAATTC
CTATACATTATTGTGCTCCAGCTGGTTATGCGATTCTAAAGTGTAATAATAAGACATTCAATGGAACAGGACCGTGT
AATAATGTCAGCACAGTACAATGTACTCATGGAATTAAGCCAGTGGTTTCAACTCAACTATTGTTAAATGGTAGCCT
AGCAGAAGGAGAGATAATAATTAGATCTAAAAATATAACAGACAATAGCAAAACAATAATAGTACATCTCAATGAAT
CTGTAAAGATTGAGTGTACGAGACCCAGTAATAACACAAGAACAAGTATAAGAATAGGACCAGGACAAGCATTTTAT
GCAACAGGAGACATAAGAGGAAATATAAGAGAAGCACATTGTAACATTAGTGAAGATAAATGGAATGAAACTTTACA
AAGGGTAAGTGAAAAATTAAAAGAATACTTCCCTCAAAAGAATATAACCTTTCAACCATCCTCAGGAGGGGACCTAG
AAATTACAACACATAGCTTTAATTGTGGAGGAGAATTTTTCTATTGCAATACATCAAGCCTGTTTAATAGGACATAT
ATGGCTACTGGTACAGATATGGCTAATAGTACAGAAACTAACATCATCACAATCCACTGCAGAATAAAACAAATTAT
AAACATGTGGCAGGAGGTGGGACGAGCAATGTATGCCCCTCCCATTGCAGGAAACATGTATATCAAATATCA
CAGGACTACTATTGACAAGGATGGAGGAAACAGTACAGAGCATTCAGACCTGTAGGAGGAAATATG
AAGGACAATTGGAGCAGTGAATTATATAAATATAAAGTGGTAGAAGTTAAGCCATTAGGAGTAGCACCCACTAATGC
AAGAAGGAGAGTGGTGGAGAGAGAAAAAGAGCAGTGGGAATGGGAGCTGTGTTCCTTGGGTTCTTGGGAGCGGCAG
GAAGCACTATGGGCGCAGCATCAATAACGCTGACGGTACAGGCCAGACAATTATTGTCTGGTATAGTGCAACAGCAA
AGCAATTTGCTGAAGGCTATAGAGGCTCAACAGCATATGTTGAAACTCACGGTCTGGGGCATTAAACAGCTCCAGGC
AAGAGTCCTGGCCTTGGAAAGATACCTAAAGGATCAACAGCTCCTAGGGATGTGCTCTGGAAAACTCATCT
GCACCACTAATGTATATTGGAACTCTAGCTGGAGTAATAAAACTTATGATGATATTTGGGATAACATGACCTGGATG
CAGTGGGAGAGAAATTAGCAATTATACAAACATAATATATGAATTGCTTGAAGAATCACAAAACCAGCAGGAAAA
GAATGAACAAGATTTACTAGCATTGGACAGATGGAACAGTCTGTGGAATTGGTTTAACATAACAAATTGGCTGTGGT
ATATAAAAATATTCATAATGATAGTAGGAGGCTTGATAGGTTTAAGAATAATTTTTGCTGTGCTTTCTTTAGTAAAT
AGAGTTAGGCAGGGATACTCACCTCTGTCATTGCAGACCCTTATCCCAAGCCCGAGGGGACCAGACAGGCCCGGAGG
AATCGAAGAAGAAGGTGGAGAGCAAGACAGAAACAGATCAACGCGATTAGTGAGCGGATTCTTAGCGCTTGCCTGGG
ACGACCTGCGGAGCCTGTGCCTTTTCATCTACCACCGATTGAGAGACTTCATATTAATTGCAGCGAGAGCGGGGGAA
CTTCTGGGACGCAGCAGTCTCAAGGGACTACGGAGAGGGTGGGAAGCCCTTAAGTATCTGGGAAGTCTTGTGCAGTA
TTGGGGCCTGGAACTAAAAAGGAGTGCTATTAGTCTATTGGATACCCTAGCAATAGCAGTAGGTGAAGGAACAGATA

FIG. 17B cont'd

```
GGATTCTAGAATTTGTATTAGGAATTTGTAGAGCTATCCGCAACATACCTACAAGAATAAGACAGGGCTTTGAAACA
GCTTTGCTGTAA
>703010505.W160.A2
ATGAGAGTGAGGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTTAACATGTGGGAAAATGACATGGTGGATCAGATGCATGAAGA
TGTAATTAGTTTATGGGATCAAAGCCTCAAGCCATGTGTAAGGTTGACCCCACTCTGTGTCACTCTAAACTGTATCA
ATGCTACTAATGCTACTGCCAGCGATAGCAGTATATTAGATGGAATGAAAAATTGCTCTTTCAATATAACCACAGAA
TTAAGAGATAAGAGAGAGAAAAAGAATGCACTTTTTTTATAAACTTGATATAGTACAACTAGGTGGCAACTCTAGTC
AGTATAGATTAATAAATTGTAATACCTCAGTCATAACACAAGCCTGTCCAAAGGTCTCTTTTGACCCAATTCCTATA
CATTATTGTGCTCCAGCTGGTTATGCGATTCTAAAGTGTAATAAGACATTCAATGGAACAGGACCCGTGTAATAA
TGTCAGCACAGTACAATGTACACATGGAATTAAGCCAGTGGTTTCAACTCAACTATTGTTAAATGGTAGCCTAGCAG
AAGGAGAGATAATAATTAGATCTAAAAATATAACAGACAATAGCAAAACAATAATAGTACATCTCAATGAATCTGTA
AAGATTGAGTGTACGAGACCCAGTAATAACACAAGAACAAGTATAAGAATAGGACCAGGACAAGCATTTTATGCAAC
AGGACAAGTAATAGGAAATATAAGAGAAGCACATTGTAACATTAGTGAAAGTAAATGGAATGAAACTTTACAAAGGG
TAAGTGAAAAATTAAAAGAATACTTCCCTGATAAGAATATAACATTTCAACCATCCTCAGGAGGGGACCTAGAAATT
ACAACACATAGCTTTAATTGTGGAGGAGAATTTTTCTATTGCAATACATCAAGCCTGTTTAATAGGACATATATGGC
TACTAGTACAGATATGGCTAATAGTACAGAAACTAACAGTACACAAATCATCACAATCCACTGCAGAATAAAACAAA
TTATAAACATGTGGCAGGAGGTGGGACGAGCAATGTATGCCCCTCCCATTGCAGGAAACATAACATGTATATCAAAT
GTCACAGGACTACTATTGACAAGGGATGGAGGAAATAATACAGAGGGATACGGAGACATTCAGACCTGTAGGAGGAAA
TATGAAGGACAATTGGAGCAGTGAATTATATAAATATAAAGTGGTAGAAGTTAAGCCATTAGGAGTAGCACCCACTA
ATGCAAGAAGGAGAGTGGTGGAGAGAGAAAAAAGAGCAGTGGGAATGGGAGCTGTGTTCCTTGGGTTCTTGGGAGCG
GCAGGAAGCACTATGGGCGCAGCATCAATAACGCTGACGGTACAGGCCAGACAATTATTGTCTGGTATAGTGCAACA
GCAAAGCAATTTGCTGAAGGCTATAGAGGCTCAACAGCATATGTTGAAACTCACGGTCTGGGGCATTAAACAGCTCC
AGGCAAGAGTCCTGGCCTTGGAAAGATACCTAAAGGATCAACAGCTCCTAGGGATGTGGGGCTGCTCTGGAAAACTC
ATCTGCACCACTAATGTATATTGGAACTCTAGTTGGAGTAATAAAACTTATGATGATATTTGGGATAACATGACCTG
GATGCAGTGGGAGAGAGAAAATTAGCAATTATACAGAACTAATATATGAATTGCTTGAAGAATCACAAAACCAGCAGG
AAAAGAATGAACAAGATTTACTAGCATTGGACAGATGGAACAGTCTGTGGAATTGGTTTAACATAACAAATTGGCTG
TGGTATATAAAAATATTCATAATGATAGTAGGAGGCTTGATAGGTTTAAGAATAATTTTTGCTGTGCTTTCTTTAGT
AAATAGAGTTAGGCAGGGATACTCACCTCTGTCATTGCAGACCCTTATCCCAAGCCCGAGGGGACCAGACAGGCCCG
GAGGAATCGAAGAAGAAGGTGGAGAGCAAGACAGAAACAGATCAACGCGATTAGTGAGCGGATTCTTAGCGCTTGCC
TGGGACGACCTGCGGAGCCTGTGCCTTTTCATCTACCACCGATTGAGAGACTTCATATTAATTGCAGCGAGAGCGGG
GGAACTTCTGGGACGCAGCAGTCTCAAGGGACTACGGAGAGGGTGGGAAGCCCTTAAGTATCTGGGAAGTCTTGTGC
AGTATTGGGGCCTGGAACTAAAAAGGAGTGCTATTAGTCTATTGGATACCCTAGCAATAGCAGTAGGTGAGGGAACA
GATAGGATTCTAGAATTTGTATTAGGAATTTGTAGAGCTATCCGCAACATACCTACAAGAATAAGACAGGGCTTTGA
AACAGCTTTGCTATAA
>703010505.W160.A4
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTGGATCAGATGCATGAAGA
TGTAATTAGTTTATGGGATCAAAGCCTCAAGCCATGTGTAAGTTGACCCCACTCTGTGTCACTCTAAACTGTATCA
ATGCTACTAATGCTACTGCCAGCAATAGCAATATATTAGAGGGAATGAAAAATTGCTCTTTCAATATAACCACAGAA
TTAAGAGATAAGAGAGAGAAAAAGAATGCACTTTTTTTATAAACTTGATATAGTACAACTAGGTGGCAACTCTAGTC
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTAATAACACAAGAACAAGTATAAGGATAGGACCAGGACAAGCATTTTATGCAACA
GGACAAGTAATAGGAAATATAAGAGAAGCACATTGTAACATTAGTGAAAGTAAATGGAATGAGACTTTACAAAGGGT
AAGTGAAAAATTAAAAAAAATACTTCCCTGATAAGAATATAACATTTCGACCATCCTCAGGAGGGGACCTAGAAATT
ACAACACATAGCTTTAATTGTGGAGGAGAATTTTTCTATTGCAATACATCAAGCCTGTTTAATAGGACATATATGGC
TACTAGTACAGATATGGCTAATAGTACAGAAACTAACATCATCCACTGCAGAATAAAACAAATTATAAACA
TGTGGCAGGAGGTGGGACGAGCAATGTATGCCCCTCCCATTGCAGGAAACATAACATGTATATCAAATATCACAGGA
CTACTATTGACAAGGGATGGAGGAAACAATACAGAGGATACGGAGACATTCAGACCTGTAGGAGGAAATATGAAGGA
CAATTGGAGCAGTGAATTATATAAATATAAAGTGGTAGAAGTTAAGCCATTAGGAGTAGCACCCACTAATGCAAGAA
GGAGAGTGGTGGAGAGAGAAAAAAGAGCAGTGGGAATGGGAGCTGTGTTCCTTGGGTTCTTGGGAGCGGCAGGAAGC
ACTATGGGCGCAGCATCAATAACGCTGACGGTACAGGCCAGACAATTATTGTCTGGTATAGTGCAACAGCAAAGCAA
TTTGCTGAAGGCTATAGAGGCTCAACAGCATATGTTGAAACTCACGGTCTGGGGCATTAAACAGCTCCAGGCAAGAG
TCCTGGCCTTGGAAAGATACCTAAAGGATCAACAGCTCCTAGGGATGTGGGGCTGCTCTGGAAAACTCATCTGCACC
ACTAATGTATATTGGAACTCTAGCTGGAGTAATAAAACTTATAGTGATATTTGGGATAACATGACCTGGATGCAGTG
GGAGAGAGAAATTAGCAATTATACAGACATGATATATGAATTGCTTGAAGAATCACAAAACCAGCAGGAAAAGAATG
AACAAGATTTACTAGCATTGGACAGATGGAACAGTCTGTGGAATTGGTTTAACATAACAAATTGGCTGTGGTATATA
AAATATTCATAATGATAGTAGGAGGCTTGATAGGTTTAAGAATAATTTTTGCTGTGCTTTCTTTAGTAAATAGAGT
TAGGCAGGGATACTCACCTCTGTCATTGCAGACCCTTATCCCAAGCCCGAGGGGACCAGACAGGCCCGGAGGAATCG
AAGAAGAAGGTGGAGAGCAAGACAGAAACAGATCAACGCGATTAGTGAGCGGATTCTTAGCGCTTGCCTGGACGAC
CTGCGGAGCCTGTGCCTTTTCATCTACCACCGATTGAGAGACTTCATATTAATTGCAGCGAGAGCAGGGGAACTTCT
GGGACGCAGCAGTCTCAAGGGACTACGGAGAGGGTGGGAAGCCCTTAAGTATCTGGGAAGTCTTGTGCAGTATTGGG
GCCTGGAACTAAAAAGGAGTGCTATTAGTCTATTGGATACCCTAGCAATAGCAGTAGGTGAGGGAACAGATAGGATT
```

FIG. 17B cont'd

CTAGAATTTGTATTAGGAATTTGTAGAGCTATCCGCAACATACCTACAAGAATAAGACAGGGCTTTGAAACAGCTTT
GCTATAA
>793010505.W160.A5
ATGAGAGTGAGGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGGAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGACAGCAATAGCAGTATATTAGGGGGAATGAAAAATTGCTCTTTCAATATAACCACAGAA
TTAAGAGATAAGAGAGAGAAAAAGAATGCACTTTTTTTATAAACTTGATATAGTACAACTAGGTAGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAAACTTTACAAAGGGT
AAGTGAAAAATTAAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAGTAGGACATATATGGCT
AATAGTACAGATATGGCTAATAGTACAGAAACTAACAGTACACAAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAACAATACAGAGGATACGGAGACATTCAGACCTGAAGGAGGAAAT
ATGAAGGACAATTGGAGCAGTGAATTATATAAATATAAAGTGGTAGAAGTTAAGCCATTAGGAGTAGCACCCACTAA
TGCAAGAAGGAGAGTGGTGGAGAGAGAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGTTGGAGTAATAAAACTTATGATGATATTTGGGATAACATGACCTGG
ATGCAGTGGGAGAGAGAAATTAGCAATTATACAGACCTAATATATGAATTGCTTGAAGAATCACAAAACCAGCAGGA
AAAGAATGAACAAGATTTACTAGCATTGGACAGATGGAACAGTCTGTGGAATTGGTTTAACATAACAAACTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAGGGAACAG
ATAGGATTCTAGAATTTGTATTAGGAATTTGTAGAGCTATCCGCAACATACCTACAAGAATAAGACAGGGCTTTGAA
ACAGCTTTGCTATAA
>793010505.W160.B2
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGGAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGCCAGCGATAGCAGTATATTAGATGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGGCCATGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATTTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAGACTTTACAAAGGGT
AAGTGAAAAATTAAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
AATAGTACAGATATGGCTAATAGTACAGAAACTAACAGTACACAAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAACAATACAGAGGATACGGAGACATTCAGACCTGTAGGAGGAAAT
ATGAAGGACAATTGGAGCAGTGAATTATATAAATATAAAGTGGTAGAAGTTAAGCCATTAGGAGTAGCACCCACTAA
TGCAAGAAGGAGAGTGGTGGAGAGAGAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGCTGGAGTAATAAAACTTATGATGATATTTGGGATAACATGACCTGG
ATGCAGTGGGAGAGAGAAATTAGCAATTATACAAACATAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAGGGAACAG

FIG. 17B cont'd

```
ATAGGATTCTAGAATTTGTATTAGGAATTTGTAGAGCTATCCGCAACATACCTACAAGAATAAGACAGGGCTTTGAA
ACAGCTTTGCTATAA
>703010565.W160.C1
ATGAGAGTGACGGGGATACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGGATATGAGAAGGAAGTGCATAATGTCTGGGCTACACATGCCTGTGTACCCACAGACCCCAATCCA
CAAGAAATGGTTTTAAAAAATGTAACAGAAAATTTTAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTATACTGTACCA
ATGCTACTGCTAATGCTACTGCCAGCAATATCAATGTTACTGTCAGCAATAGCAGTATAATAGAGGAAATGAAAAAT
TGCTCTTTCAATATAACCACAGAATTAAGAGATAAGAGAGAGAAAAAGTATGCACTTTTTTATAAACTTGATATAAT
ACAACTAGATGGCAGCTCTAGTCAGTATAGATTAATAAATTGTAATACCTCAGCCATAACACAAGCCTGTCCAAAGG
TCTCTTTTGACCCAATTCCTATACATTATTGTGCTCCAGCTGGTTATGCGATTCTAAAGTGTAATAATAAGACATTC
AATGGAACAGGACCGTGTAATAATGTCAGCACAGTACAATGTACACATGGAATTAAGCCAGTGGTTTCAACTCAACT
ATTGTTAAATGGTAGCCTAGCAGAAGGAGAGATAATAATTAGATCTGAAATATAACAAACAGTGCCAAAACAATAA
TAGTACATCTCAATGAATCTGTAAAGATTGAGTGTACGAGACCCAGTAATAACACAAGAACAAGTATAGGAATAGGA
CCAGGACAAGCATTTTATGCAACAGGACAAGTAATAGGAGACATAAGAAAAGCACATTGTAACATTAGTGAAAGTAA
ATGGAATGAAACTTTACAAAGGGTAAGTAAAAAATTAAAAGAATACTTCCCTGATAAGAATATAACATTTCAACCAT
CCTCAGGAGGGGACCCAGAAGTTACAACACATAGCTTTAATTGTGGAGGAGAATTTTTCTATTGCAATACATCAAGC
CTGTTTAATAGGACATATATGCTAATAAGTACAGATATGGCTAATAGTACAGAAACTAACAGAACCATCACAATCCA
CTGCAGAATAAAACAGATTATAAACATGTGGCAGGAGGTGGGACGAGCAATGTATGCCCCTCCCATTGCAGGAAACA
TAACATGTATATCAAATATCACAGGACTACTATTGACAAGGGATGGAGGAAACAGCAGTACGGGGACAGAGACATTC
AGACCTGGAGGAGGAAATATGAAGGACAATTGGAGAAGTGAATTATATAAATATAAAGTGGTAGAAGTTAAGCCATT
AGGAGTAGCACCCACTAATGCAAGAAGGAGAGTGGTGGAGAGAGAAAAAGAGCAGTGGGAATGGGAGCTGTGTTCC
TTGGGTTCTTGGGAGCGGCAGGAAGCACTATGGGCGCAGCATCAATAACGCTGACGGTACAGGCCAGACAATTATTG
TCTGGTATAGTGCAACAGCAAAGCAATTTGCTGAAGGCTATAGAGGCTCAACAGCATATGTTGAAACTCACGGTCTG
GGGCATTAAACAGCTCCAGGCAAGAGTCCTGGCCTTGGAAAGATACCTAAAGGATCAACAGCTCCTAGGGATGTGGG
GCTGCTCTGGAAAACTCATCTGCACCACTAATGTATATTGGAACTCTAGTTGGAGTAATAAAACTTATGTTGATATT
TGGGATAACATGACCTGGATGCAGTGGGAGAGAGAAATTAGCAATTATACAGACATAATATATGACTTGCTTGAAGA
ATCACAAAACCAGCAGGAAAAGAATGAACAAGATTTACTAGCATTGGACAGATGGAACAGTCTGTGGAATTGGTTTA
ACATAACAAATTGGCTGTGGTATATAAAAATATTCATAATGATAGTAGGAGGCTTGATAGGTTTAAGAATAATTTTT
GCTGTGCTTTCTTTAGTAAATAGAGTTAGGCAGGGATACTCACCTCTGTCGTTGCAGACCCTTATCCCAAGCCCGAG
GGGACCAGACAGGCCCGGAGGAATCGAAGAAGAAGGTGGAGAGCAAGCAGAAACAGATCAACGCGATTAGTGAGCG
GATTCTTAGCGCTTGCCTGGGACGACCTGCGGAGCCTGTGCCTTTTCCTCTACCACCGATTGAGAGACTTCATATTA
ATTGCAGCGAGAGCGGGGGAACTTCTGGGACGCAGCAGTCTCAAGGGACTACGGAGAGGGTGGGAAGCCCTTAAGTA
TCTGGGAGGTCTTGTGCAGTATTGGGGCCTGGAACTAAAAAGGAGTGCTATTAGTCTATTAGATACCCTAGCAATAG
CAGTAGGTGAACGAACAGATAGGATTCTAGAATTTGTATTAGGAATTTGTAGAGCTATCCGCAACATACCTACAAGA
ATAAGACAGGGCTTTGAAACAGCTTTGCTATAA
>703010565.W160.C10
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGAAAAATGACATGGTAGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGCCAGCGATAGCAGTATATTAGATGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACAGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAAACTTTACAAAGGGT
AAGTGAAAAATTAAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAACCCTGTTTAATAGGACATATATGGCT
AATAGTACAGATATGGCTAATAGTACAGAAACTAACAGTACACAAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAACAATACGGAGACATCCGAGACAGTCTCCGAGATATTCAGACCT
GTAGGAGGAAATATGAAGGACAATTGGAGCAGTGAATTATATAAATATAAAGTGGTAGAAGTTAAGCCATTAGGAGT
AGCACCCACTAATGCAAGAAGGAGAGTGGTGGAGAGAGAAAAAAGAGCAGTGGGAATGGGAGCTGTGTTCCTTGGGT
TCTTGGGAGCGGCAGGAAGCACTATGGGCGCAGCATCAATAACGCTGACGGTACAGGCCAGACAATTATTGTCTGGT
ATAGTGCAACAGCAAAGCAATTTGCTGAAGGCTATAGAGGCTCACCAGCATATGTTGAAACTCACGGTCTGGGGCAT
TAAACAGCTCCAGGCAAGAGTCCTGGCCTTGGAAAGATACCTAAAGGATCAACAGCTCCTAGGGATGTGGGGCTGCT
CTGGAAAACTCATCTGCACCACTAATGTATATTGGAACTCTAGCTGGAGTAATAAAACTTATGATGATATTTGGGAT
AACATGACCTGGATGCAGTGGGAGAGAGAAATTAGCAATTATACAGAAAATAATATATGAATTGCTTGAAGAATCACA
AAACCAGCAGGAAAAGAATGAACAAGATTTACTAGCATTGGACAGATGGAACAGTCTGTGGAATTGGTTTAACATAA
CAAATTGGCTGTGGTATATAAAAATATTCATAATGATAGTAGGAGGCTTGATAGGTTTAAGAATAATTTTTGCTGTG
CTTTCTTTAGTAAATAGAGTTAGGCAGGGATACTCACCTCTGTCATTGCAGACCCTTATCCCAAGCCCGAGGGGACC
AGACAGGCCCGGAGGAATCGAAGAAGAAGGTGGAGAGCAAGCAGAAACAGATCAACGCGATTAGTGAGCGGATTCT
TAGCGCTTGCCTGGGACGACCTGCGGAGCCTGTGCCTTTTCATCTACCACCGATTGAGAGACTTCATATTAATTGCA
GCGAGAGCGGGGAACTTCTGGGACGCAGCAGTCTCAAGGGACTACGGAGAGGGTGGGAAGCCCTTAAGTATCTGGG
AAGTCTTGTGCAGTATTGGGGCCTGGAACTAAAAAGGAGTGCTATTAGTCTATTGGATACCCTAGCAATAGCAGTAG
```

FIG. 17B cont'd

```
GTGAGGGAACAGATAGGATTCTAGAATTTGTATTAGGAATTTGTAGAGCTATCCGCAACATACCTACAAGAATAAGA
CAGGGCTTTGAAACAGCTTTGCTATAA
>703010505.W160.C11
ATGAGAGTGAGGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGGAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGCCAGCGATAGCAGTATATTAGATGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAAPAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAGACTTTACAAAGGGT
AAGTGAAAAATTAAAAAAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
ACTAGTACAGATTTGGCTAATAGTACAGAAACTAACATCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAACAATACAGAGGATACGGAGACATTCAGACCTGTAGGAGGAAATATGAAGGAC
AATTGGAGCAGTGAATTTATATAAATATTAAAGTGGTAGAAGTTAAGCCATTAGGAGTAGCACCCACTAATGCAAGAAG
GAGAGTGGTGAAGAGAAAAAAGAGCAGTGGGAATGGGAGCTATGTTCCTTGGGTTCTTGGGAGCGGCAGGAAGCA
CTATGGGCGCAGCATCAATAACGCTGACGGTACAGGCCAGACAATTATTGTCTGGTATAGTGCAACAGCAAAGCAAT
TTGCTGAAGGCTATAGAGGCTCAACAGCATATGTTGAAACTCACGGTCTGGGGCATTAAACAGCTCCAGGCAAGAGT
CCTGGCCTTGGAAAGATACCTAAAGGATCAACAGCTCCTAGGGATGTGGGGCTGCTCTGGAAAACTCATCTGCACCA
CTAATGTATATTGGAACTCTAGCTGGAGTAATAAAACTTATGATGATATATTTGGGATAACATGCCTGGATGCAGTGG
GAGAGAGAAATTAGCAATTATACAGAACTAATATATGAATTGCTTGAAGAATCACAAAACCAGCAGGAAAAGAATGA
ACAAGATTTACTAGCATTGGACAGATGGAACAGTCTGTGGAATTGGTTTAACATAACAAATTGGCTGTGGTATATAA
AAATATTCATAATGATAGTAGGAGGCTTGATAGGTTTAAGAATAATTTTTGCTGTGCTTTCTTTAGTAAATAGAGTT
AGGCAGGGATACTCACCTCTGTCATTGCAGACCCTTATCCCAAGCCCGAGGGGACCAGACAGGCCCGGAGGAATCGA
AGAAGAAGGTGGAGAGCAAGACAGAAACAGATCAACGCGATTCTTAGCGCTTGCCTGGGACGACC
TGCGGAGCCTGTGCCTTTTCATCTACCACCGATTGAGAGACTTCATATTAATTGCAGCGAGAGCGGGGGAACTTCTG
GGACGCAGCAGTCTCAAGGGACTACGGAGAGGGTGGGAAGCCCTTAAGTATCTGGGAAGTCTTGTGCAGTATTGGGG
CCTGGAACTAAAAGGAGTGCTATTAGTCTATTGGATACCCTAGCAATAGCAGTAGGTGAGGGAACAGATAGGATTC
TAGAATTTGTATTAGGAATTTGTAGAGCTATCCGCAACATACCTACAAGAATAAGACAGGGCTTTGAAACAGCTTTG
CTATAA
>703010505.W160.C12
ATGAGAGTGATGGGGAGACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGGATATGAGAAGGAAGTGCATAATGTCTGGGCTACACATGCCTGTGTACCCACAGACCCCAATCCA
CAAGAAATGGTTTTAAAAAATGTAACAGAAAATTTCAACATGTGGGAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTAATGCTACTGCCAGCAATGCTAATGCTACTGTCAGCAATACCAATGCTACTGTCAGCAATGATAGCAGTATA
ATAGAGGAAATGAAAAATTGCTCTTTCAATATAACCACAGAATTAAGAGATAAGATAGAGAAAAAGTATGCACTTTT
TTATAAACTTGATATAGTACAACTAGATGGCAACTCTACTCATTATAGATTCATAAATTGTAATACCTCAGCCATAA
CACAAGCCTGTCCAAAGGTCTCTTTTGACCCAATTCCTATACATTATTGTGCTCCAGCTGGTTATGCGATTCTAAAG
TGTAATAAGACATTCAATGGAACAGGACCGTGTAATAATGTCAGCACAGTACAATGTACACATGGAATTAAGCC
AGTGGTTTCAACTCAACTATTGTTAAATGGTAGCCTAGCAGAGGAGATAATAATTAGATCTAAAAATATAACAG
ACAATGGCAAAACAATAATAGTACATCTCAATGAATCTGTAAAGATTGAGTGTACGAGACCCAGTAATAACACAAGA
ACAAGTATAGGAATAGGACCAGGACAAGCATTTTATGCAACAGGACAAGTAATAGGAGACATAAGAAAAGCACATTG
TAACATTAGTGAAAGTAAATGGAATGAAACTTTACAAAGGGTAAGTGAAAAATTAAAAGAAGCACATTCCCTGGTAAGA
ATATAACATTTCAACCATCCTCAGGAGGGGACCCAGAAGTTACAACACATAGCTTTAATTGTGGAGGAGAATTTTTC
TATTGCAATACATCAAGCCTGTTTAATAGGACATATATGACTAATAGTACAGATATGGCTAATAGTACAGAAACTAA
CAGAACCATCACAATCCACTGCAGAATAAAACAAATTATAAACATGTGGCAGGAGGTGGGACGAGCAATGTATGCCC
CTCCCATTGCAGGAAACATAACATGTATATCAAATATCACAGGACTACTATTGACAAGGGATGGAGGAAACAGCAGT
ACGGAGACAGAGACATTCAGACCTGAGGAGGAAATATGGAGGACAATTGGAGAAGTGAATTATATAAATATAAAGT
GGTAGAAGTTAAGCCATTAGGAGTAGCACCCACTAATGCAAGAAGGAGAGTGGTGGAGAGAGAAAAAAGAGCAGTGG
GAATGGGAGCTGTGTTCCTTGGGTTCTTGGGAGCGGCAGGAAGCACTATGGGCGCAGCATCAATAACGCTGACGGTA
CAGGCCAGACAATTATTGTCTGGCATAGTGCAACAGCAAAGCAATTTGCTGAAGGCTATAGAGGCTCAACAGCATAT
GTTGAGACTCACGGTCTGGGGCATTAAACAGCTCCAAGCAAGAGTCCTGGCCTTGGAAAGATACCTAAAGGATCAAC
AGCTCCTAGGGATGTGGGGCTGCTCTGGAAAACTCATCTGCACCACTAATGTATATTGGAACTCTAGTTGGAGTAAT
AAAACTTATGATGATATTTGGGATAACATGACCTGGATGCAGTGGGAGGGAGAAATTAGCAATTACACAAACATTAT
ATATGACTTGCTTGAAGAATCACAAAACCAGCAGGAAAAGAATGAACAAGATTTACTAGCATTGGACAGATGGAACA
GTCTGTGGAATTGGTTTAACATAACAAAGTGGCTGTGGTATATAAAAATATTCATAATGATAGTAGGAGGCTTGATA
GGTTTAAGAATAATTTTTGCTGTGCTTTCTTTAGTAAATAGAGTTAGGCAGGGATACTCACCTCTGTCGTTGCAGAC
CCTTATCCCAAGCCCGAGGGGACCAGACAGGCCCGGAGGAATCGAAGAAGAAGGTGGAGAGCAAGACAGAAAGAGAT
CAACGCGATTAGTGAGCGGATTCTTAGCGCTTGTCTGGGACCTGCGGAGCCTGTGCCTTTTCCTCTACCACCGA
TTGAGAGACTTCATATTAATTGCAGCGAGAGCGGGGGAACTTCTGGGACGCAGCAGTCTCAAGGGACTACGAAGAGG
GTGGGAAGCCCTTAAGTATCTGGGAAGTCTTGTGCAGTATTGGGGCCTGGAACTAAAAGGGAGTGCTATTAGTCTAT
```

FIG. 17B cont'd

```
TGGATACCCTAGCAATAGCAGTAGGTGAAGGAACAGATAGGATTCTAGAATTTGTATTAGGAATTTGTAGAGCTATC
CGCAACATACCCACAAGAATAAGACAGGGCTTTGAAACAGCTTTGCTATAA
>703010505.W160.C14
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCCACAGACCCCAATCCA
CAAGAAATGGTTTTAAAAAATGTAACAGAAAATTTTAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGACAGCAAAAGCAATATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGGTAGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTTAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAAACTTTACAAAGGGT
AAGTGAAAAATTAAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
AATAGTACAGATATGGCTAATAGTACAGAAACTAACAGTACACAAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAACAATACAGAGGATACGGAGACATTCAGACCTGTAGGAGGAAAT
ATGAAGGACAATTGGAGCAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGCATTAAACAGCTCCA
GGCAAGAGTCCTGGCCTTGGAAAGATACCTAAAGGATCAACAGCTCCTAGGGATGTGGGCTGCTCTGGAAAACTCA
TCTGCACCACTAATGTATATTGGAACTCTAGCTGGAGTAATAAAACTTATGATGATATTTGGGATAACATGACCTGG
ATGCAGTGGGAGAGAGAAATTAGCAATTATACAAACATAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTACA
GTATTGGGGCCTGGAACTAAAAAGGAGTGCTATTAGTCTATTGGATACCCTAGCAATAGCAGTAGGTGAGGGAACAG
ATAGGATTCTAGAATTTGTATTAGGAATTTGTAGAGCTATCCGCAACATACCTACAAGAATAAGACAGGGCTTTGAA
ACAGCTTTGCTATAA
>703010505.W160.C2
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCCACAGACCCCAATCCA
CAAGAAATGGTTTTAAAAAATGTAACAGAAAATTTTAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGCCAGCGATAGCAGTATATTAGATGGAATGAAAAATTGCTCTTTCAATATAACCACAGAA
TTAAGAGATAAGAGAGAGAAAAAGAATGCACTTTTTTATAAACTTGATATAGTACAACTAGGTAGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAAACTTTACAAAGGGT
AAGTGAAAAATTAAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
AATAGTACAGATATGGCTAATAGTACAGAAACTAACAGTACACAAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAACAATACAGAGGATACGGAGACATTCAGACCTGTAGGAGGAAAT
ATGAAGGACAATTGGAGCAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGCATTAAACAGCTCCA
GGCAAGAGTCCTGGCCTTGGAAAGATACCTAAAGGATCAACAGCTCCTAGGGATGTGGGCTGCTCTGGAAAACTCA
TCTGCACCACTAATGTATATTGGAACTCTAGTTGGAGTAATAAAACTTATGATGATATTTGGGATAACATGACCTGG
ATGCAATGGGAGAGAGAAATTAGCAATTATACAGAAATAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTACA
GTATTGGGGCCTGGAACTAAAAAGGAGTGCTATTAGTCTATTGGATACCCTAGCAATAGCAGTAGGTGAGGGAACAG
```

FIG. 17B cont'd

```
ATAGGATTCTAGAATTTGTATTAGGAATTTGTAGAGCTATCCGCAACATACCTACAAGAATAAGACAGGGCTTTGAA
ACAGCTTTGCTATAA
>703010505.W160.C3
ATGAGAGTGATGGGGAGACAGAGGAATTATCCACAATGGTGGATATGGAGCATGTTAGGCTTGTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGGATATGAGAAGGAAGTGCATAATGTCTGGGCTACACATGCCTGTGTACCCACAGACCCCAATCCA
CAAGAAATGGTTTTAAAAAATGTAACAGAAAATTTCAACATGTGGGAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTAATGCTACTGCCAGCAATGCTAATGCTACTGTCAGCAATACCAATGCTACTGTCAGCAATGATAGCAGTATA
ATAGAGGGAAATGAAAAATTGCTCTTTCAATATAACCACAGAATTAAGAGATAAGATAGAGAAAAAGTATGCACTTTT
TTATAAACTTGATATAGTACAACTAGATGGCAACTCTACTCATTATAGATTCATAAATTGTAATACCTCAGCCATAA
CACAAGCCTGTCCAAAGGTCTCTTTTTGACCCAATTCCTATACATTATTGTGCTCCAGCTGGTTATGCGATTCTAAAG
TGTAATAATAAGACATTCAATGGAACAGGACCGTGTAATAATGTCACCCACAGTACAATGTACACATGGAATTAAGCC
AGTGGTTTCAACTCAACTATTGTTAAATGGTAGCCTAGCAGAAGGAGAGATAATAATTAGATCTAAAAATATAACAG
ACAATGGCAACACAATAATAGTACATCTCAATGAATCTGTAAAGATTGAGTGTACGAGACCCGGTAATAACACAAGA
ACAAGTATAAGAATAGGACCAGGACAAGCATTTTATGCAACAGGACAAGTAATAGGAGACATAAGACAAGCACATTG
TAACATTAGTGAAAGTAAATGAATGAAAACTTTACAAAGGGTAAGTGAAAAATTAAAAGAATACTTCCCTAATAAGA
CTATAACATTTCAACCATCCTCAGGAGGGGACCCAGAAGTTACAACACATAGCTTTAATTGTGGAGGAGAATTTTTC
TATTGCAATACATCAAGCCTGTTTAATAGGACATATATGACTAATAGTACAGATATGGCTAATAGTACAGAAACTAA
CAGAACCATCACAATCCACTGCAGAATAAAACAAATTATAAACATGTGGCAGGAGGTGGGACGAGCAATGTATGCTC
CTCCCATTGCAGGAAACATAACATGTATATCAAATATCACAGGACTACTATTGACAAGGGATGGAGGAAACAATACG
GATCCGGAGATATTCAGACCTGGAGGAGGAAATATGAAGGACAATTGGAGAAGTGAATTATATAAATATAAAGTGGT
AGAAGTTAAGCACTTAGGAGTAGCACCCACTAATGACAAGAAGGAGAGTGGTGGAGAGAGAAAAAAGAGCAGTGGGAA
TGGGAGCTGTGTTCCTTGGGTTCTTGGGAGCGGCAGGAAGCACTATGGGCGCAGCATCAATAACGCTGACGGTACAG
GCCAGACAATTATTGTCTGGCATAGTGCAACAGCAAAGCAATTTGCTGAAGGCTATAGAGGCTCAACAGCATATGTT
GAGACTCACGGTCTGGGGCATTAAACAGCTCCAGGCAAGAGTCCTGGCCTTGGAAAGATACCTAAAGGATCAACAGC
TCCTAGGGATGTGGGGCTGCTCTGGAAAACTCATCTGCACCACTAATGTATATTGGAACTCTAGTTGGAGTAATAAA
ACTTATGGTGATATTTGGGATAACATGACCTCTGATGCGGTGGGAGAGTGAAATTAGCAATTATACAAACATAATATA
TGATTTGCTTGAAGAATCACAAAACCAGCAGGAAAAGAATGAACAAGATTTACTAGCATTGGACAGATGGAACAGTC
TGTGGAATTGGTTTAACATAACAAAATGGCTGTGGTATATAAAAATATTCATAATGATAGTAGGAGGCTTGATAGGT
TTAAGAATAATTTTTGCTGTGCTTTCTTTAGTAAATAGAGTTAGGCAGGGATACTCACCTCTGTCGTTGCAGACCCT
TATCCCAAGCCCGAGGGGACCAGACAGGCCCGGAGGAATCGAAGAAGAAGGTGGAGAGCAAGACAGAAAGAGATCAA
CGCGATTAGTGAGCGGATTCTTAGCGCTTGTCTGGGACGACCTGCGGAGCCTGTGCCTTTTCCTCTACCACCGATTG
AGAGACTTCACATTAATTGCAGCGAGAGCGGGGGAACTTCTGGGACGCAGCAGTCTCAAGGGACTACGAAGAGGGTG
GGAAGCCCTTAAGTATCTGGGAAGTCTTGTGCAGTATTGGGGCCTGGAACTAAAAGGGAGTGCTATTAGTCTATTGG
ATACCCTAGCAATAGCAGTAGGTGAAGGAACAGATAGGATTCTAGAATTTGTATTAGGAATTTGTAGAGCTATCCGC
AACATACCCACAAGAATAAGACAGGGCTTTGAAACAGCTTTGCTATAA
>703010505.W160.C4
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTTAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGACAGCAAAAGCAATATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCATGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATGCAAACAATAATAGTACATCTCAATGAATCTGTAAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAAACTTTACAAAGGGT
AAGTGAAAAATTAAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
AATAGTACAGATATGGCTAATAGTACAGAAACTAACAGTACCATCACACTCCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAACAATACAGAGGATACGGAGACATTCAGACCTGTAGGAGGAAAT
ATGAAGGACAATTGGAGCAGTGAATTATATAAATATAAAGTGGTAGAAGTTAAGCCATTAGGAGTAGCACCCACTAA
GGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGCTGGAGTAATAAAACTTATGATGATATTTGGGATAACATGACCTGG
ATGCAGTGGGAGAGAGAAATTAGCAATTATACAAACATAATATATGAATTGCTTGAAGAATCACAAAACCAGCAGGA
AAAGAATGAACAAGATTTACTAGCATTGGACAGATGGAACAGTCTGTGGAATTGGTTTAACATAACAAAATGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAGGGAACAG
```

FIG. 17B cont'd

```
ATAGGATTCTAGAATTTGTATTAGGAATTTGTAGAGCTATCCGCAACATACCTACAAGAATAAGACAGGGCTTTGAA
ACAGCTTTGCTATAA
>703010505.W160.C5
ATGAGAGTGAGGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTTAACATGTGGGAAAATGACATGGTGGATCAGATGCATGAAGA
TGTAATTAGTTTATGGGATCAAAGCCTCAAGCCATGTGTAAGGTTGACCCCACTCTGTGTCACTCTAAACTGTATCA
ATGCTACTAATGCTACTGCCAGCGATAGCAGTATATTAGATGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAGACTTTACAAAGGGT
AAGTGAAAAATTAAAAAAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
ACTAGTACAGATATGGCTAATAGTACAGAAACTAACATCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAACAATACAGAGGATACGGAGACATTCAGACCTGTAGGAGGAAATATGAAGGAC
AATTGGAGCAGTGAATTATATAAATATAAAGTGGTAGAAGTTAAGCCATTAGGAGTAGCACCCACTAATGCAAGAAG
GAGAGTGGTGGAGAGAGAAAAAAGAGCAGTGGGAATGGGAGCTGTGTTCCTTGGGTTCTTGGGAGCGGCAGGAAGCA
CTATGGGCGCAGCATCAATAACGCTGACGGTACAGGCCAGACAATTATTGTCTGGTATAGTGCAACAGCAAAGCAAT
TTGCTGAAGGCTATAGAGGCTCAACAGCATATGTTGAAACTCACGGTCTGGGGCATTAAACAGCTCCAGGCAAGAGT
CCTGGCCTTGGAAAGATACCTAAAGGATCAACAGCTCCTAGGGATGTGGGGCTGCTCTGGAAAACTCATCTGCACCA
CTAATGTATATTGGAACTCTAGCTGGAGTAATAAAACTTATAGTGATATTTGGGATAACATGACCTGGATGCAGTGG
GAGAGAGAAATTAGCAATTATACAGACATGATATATGAATTGCTTGAAGAATCACAAAACCAGCAGGAAAAGAATGA
ACAAGATTTACTAGCATTGGACAGATGGAACAGTCTGTGGAATTGGTTTAACATAACAAATTGGCTGTGGTATATAA
AAATATTCATAATGATAGTAGGAGGCTTGATAGGTTTACGAATAATTTTTGCTGTGCTTTCTTTAGTAAATAGAGTT
AGGCAGGGATACTCACCTCTGTCATTGCAGACCCCTTATCCCAAGCCCGAGGGGACCAGACAGGCCCGGAGGAATCGA
AGAAGAAGGTGGAGAGCAAGACAGAAACAGATCAACGCGATTCTTAGCGCTTTAGCGCTTCGCTGGACGACC
TGCGGAGCCTGTGCCTTTTCATCTACCACCGATTGAGAGACTTCATATTAATTGCAGCGAGAGCGGGGGAACTTCTG
GGACGCAGCAGTCTCAAGGGACTACGGAGAGGGTGGGAAGCCCTTAAGTATCTGGGAAGTCTTGTGCAGTATTGGGG
CCTGGAACTAAAAAAGAGTGCTATTAGTCTATTGGATACCCTAGCAATAGCAGTAGGTGAGGGAACAGATAGGATTC
TAGAATTTGTATTAGGAATTTGTAGAGCTATCCGCAACATACCTACAAGAATAAGACAGGGCTTTGAAACAGCTTTG
CTATAA
>703010505.W160.C6
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGGAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGCCAGCGATAGCAGTATATTAGATGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGCAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAGACTTTACAAAGGGT
AAGTAAAAAATTAAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
ACTAGTACAGATATGGCTAATAGTACAGAAACTAACATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAACAATACAGAGGGTACGGAGACATTCAGACCTGTAGGAGGAAAT
ATGAAGGACAATTGGAGCAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGCTGGAGTAATAAAACTTATAGTGATATTTGGGATAACATGACCTGG
ATGCAGTGGGAGAGAGAAATTAGCAATTATACAGACATGATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCCTTATCCCAAGCCCGAGGGGACCAGACAGGCCCG
GAGGAATCGAAGAAGAAGGTGGAGAGCAAGACAGAAACAGATCAACGCGATTAGTGAGCGGATTCTTAGCGCTTCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAGGGAACAG
```

FIG. 17B cont'd

ATAGGATTCTAGAATTTGTATTAGGAATTTGTAGAGCTATCCGCAACATACCTACAAGAATAAGACAGGGCTTTGAA
ACAGCTTTGCTATAA
>703010505.W160.C7
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGGAAAATGACATGGTGGATCAGATGCATGAAGA
TGTAATTAGTTTATGGGATCAAAGCCTCAAGCCATGTGTAAGGTTGACCCCACTCTGTGTCACTCTAAACTGTATCA
ATGCTACTAATGCTACTGCCAGCGATAGCAGTATATTAGATGGAATGAAAAATTGCTCTTTCAATATAACCACAGAA
TTAAGAGATAAGAGAGAGAAAAGAATGCACTTTTTTATAAACTTGATATAGTACAACTAGGTGGCAACTCTAGTCAG
TATAGATTAATAAATTGTAATACCTCAGTCATAACACAAGCCTGTCCAAAGGTCTCTTTTGACCCAATTCCTATACA
TTATTGTGCTCCAGCTGGTTATGCGATTCTAAAGTGTAATAATAAGACATTCAATGGAACAGGACCGTGTAATAATG
TCAGCACAGTACAATGTACACATGGAATTAAGCCAGTGGTTTCAACTCAACTATTGTTAAATGGTAGCCTAGCAGAA
GGAGAGATAATAATTAGATCTAAAAATATAACAGACAATAGCAAAACAATAATAGTACATCTCAATGAATCTGTAAA
GATTGAGTGTACGAGACCCAGTAATAACACAAGAACAAGTATAAGAATAGGACCAGGACAAGCATTTTATGCAACAG
GACAAGTATAGGAAATATAAGAGAAGCACATTGTAACATTAGTGAAAGTAAATGGAATGAGACTTTACAAAGGGTA
AGTGAAAAATTAAAAGAATACTTCCCTGATAAGAATATAACATTTCAACCATCCTCAGGAGGGGACCTAGAAATTAC
AACACATAGCTTTAATTGTGGAGGAGAATTTTTCTATTGCAATACATCAAGCCTGTTTAATAGGACATATATGGCTA
ATAGTACAGATATGGCTAATAGTACAGAAACTAACAGTACACAAATCATCACAATCCACTGCAGAATAAAACAAATT
ATAAACATGTGGCAGGAGGTGGGACGAGCAATGTATGCCCCTCCCATTGCAGGAAACATAACATGTATATCAAATAT
CACAGGACTACTATTGACAAGGGATGGAGGAAACAATACAGAGGATACGGAGACATTCAGACCTGTAGGAGGAAATA
TGAAGGACAATTGGAGAAGTGAATTATATAAATATAAAGTGGTAGAAGTTAAGCCATTAGGAGTAGCACCCACTAAT
GCAAGAAGGAGAGTGGTGGAGAGAGAAAAAAGAGCAGTGGGAATGGGAGCTGTGTTCCTTGGGTTCTTGGGAGCGGC
AGGAAGCACTATGGGCGCAGCATCAATAACGCTGACGGTACAGGCCAGACAATTATTGTCTGGTATAGTGCAACAGC
AAAGCAATTTGCTGAAGGCTATAGAGGCTCAACAGCATATGTTGAAACTCACGGTCTGGGGCATTAAACAGCTCCAG
GCAAGAGTCCTGGCCTTGGAAAGATACCTAAAGGATCAACAGCTCCTAGGGATGTGGGCTGCTCTGGAAAACTCAT
CTGCACCACTAATGTATATTGGAACTCTAGCTGGAGTAATAAAACTTATGATGATATTTGGGATAACATGACCTGGA
TGCAGTGGGAGAGAGAAATTAGCAATTATACAAACATAATATATGAATTGCTTGAAGAATCACAAAACCAGCAGGAA
AAGAATGAACAAGATTTACTAGCATTGGACAGATGGAACAGTCTGTGGAATTGGTTTAACATAACAAATTGGCTGTG
GTATATAAAAATATTCATAATGATAGTAGGAGGCTTGATAGGTTTAAGAATAATTTTTGCTGTGCTTTCTTTAGTAA
ATAGAGTTAGGCAGGGATACTCACCTCTGTCATTGCAGACCCTTATCCCAAGCCCGAGGGGACCAGACAGGCCCGGA
GGAATCGAAGAAGAAGGTGGAGAGCAAGACAAGAACAGATCAACGCGATTAGTGAGCGGATTCTTAGCGCTTGCCTG
GGACGACCTGCGGAGCCTGTGCCTTTTCATCTACCACCGATTGAGAGACTTCATATTAATTGCAGCGAGAGCGGGGG
AACTTCTGGGACGCAGCAGTCTCAAGGGACTACGGAGAGGGTGGGAAGCCCTTAAGTATCTGGGAAGTCTTGTGCAG
TATTGGGGCCTGGAACTAAAAGGGAGTGCTATTAGTCTATTGGATACCCTAGCAATAGCAGTAGGTGAGGGAACAGA
TAGGATTCTAGAATTTGTATTAGGAATTTGTAGAGCTATCCGCAACATACCTACAAGGATAAGACAGGGCTTTGAAA
CAGCTTTGCTATAA
>703010505.W160.C9
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGGAAAATGACATGGTGGATCAGATGCATGAAGA
TGTAATTAGTTTATGGGATCAAAGCCTCAAGCCATGTGTAAGGTTGACCCCACTCTGTGTCACTCTAAACTGTATCA
ATGCTACTAATGCTACTGCCAGCGATAGCAGTATATTAGATGGAATGAAAAATTGCTCTTTCAATATAACCACAGAA
TTAAGAGATAAGAGAGAGAAAAGAATGCACTTTTTTATAAACTTGATATAGTACAACTAGGTAGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAAACTTTACAAAGGGT
AAGTGAAAAATTAAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
AATAGTACAGATATGGCTAATAGTACAGAAACTAACAGTACACAAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAACAATACAGAGGATACGGAGACATTCAGACCTGTAGGAGGAAAT
ATGAAGGACAATTGGAGCAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGCTGCTCTGGAAAACTCA
TCTGCACCACTAATGTATATTGGAACTCTAGTTGGAGTAATAAAACTTATGATGATATTTGGGATAACATGACCTGG
ATGCAATGGGAGAGAGAAATTAGCAATTATACAGAAATAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTACA
GTATTGGGGCCTGGAACTAAAAAGGAGTGCTATTAGTCTATTGGATACCCTAGCAATAGCAGTAGGTGAGGGAACAG

FIG. 17B cont'd

ATAGGATTCTAGAATTTGTATTAGGAATTTGTAGAGCTATCCGCAACATACCTACAAGAATAAGACAGGGCTTTGAA
ACAGCTTTGCTATAA
>703010505.W160.D1
ATGAGAGTGAGGGGGATACAGAGGAGTTATCCACAATGGTGGATATGGAGCATGTTAGGCCTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGGAAAATGACATGGTGGATCAGATGCATGAAGA
TGTAATTAGTTTATGGGATCAAAGCCTCAAGCCATGTGTAAGGTTGACCCCACTCTGTGTCACTCTAAACTGTATCA
ATGCTACTAATGCTACTGCCAGCGATAGCAGTATATTAGATGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAGACTTTACAAAGGGT
AAGTGAAAAATTAAAAAAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
ACTAGTACAGATATGGCTAATAGTACAGAAACTAACATCATCACAATCCACTGCAGAATAAAACAAATTATAAACAT
GTGGCAGGAGGTGGGACGAGCAATGTATGCCCCTCCCATTGCAGGAAACATAAACATGTATATCAAATATCACAGGAC
TACTATTGACAAGGGATGGAGGAAACAATACAGAGGATACGGAGACATTCAGACCTGTAGGAGGAAATATGAAGGAC
AATTGGAGCAGTGAATTATATAAATATAAAGTGGTAGAAGTTAAGCCATTAGGAGTAGCACCCCACTAATGCAAGAAG
GAGAGTGGTGGAGAGAGAAAAAAGAGCAGTGGGAATGGGAGCTGTGTTCCTTGGGTTCTTGGGAGCGGCAGGAAGCA
CTATGGGCGCAGCATCAATAACGCTGACGGTACAGGCCAGACAATTATTGTCTGGTATAGTGCAACAGCAAAGCAAT
TTGCTGAAGGCTATAGAGGCTCAACAGCATATGTTGAAACTCACGGTCTGGGGCATTAAACAGCTCCAGGCAAGAGT
CCTGGCCTTGGAAAGATACCTAAAGGATCAACAGCTCCTAGGGATGTGGGGCTGCTCTGGAAAACTCATCTGCACCA
CTAATGTATATTGGAACTCTAGCTGGAGTAATAAAACTTATAGTGATATTTGGGATAACATGACCTGGATGCAGTGG
GAGAGAGAAATTAGCAATTATACAGACATGATATATGAATTGCTTGAAGAATCACAAAACCAGCAGGAAAAGAATGA
ACAAGATTTACTAGCATTGGACAGATGGAACAGTCTGTGGAATTGGTTTAACATAACAAATTGGCTGTGGTATATAA
AAATATTCATAATGATAGTAGGAGGTTTGATAGGTTTAAGAATAATTTTTGCTGTGCTTTCTTTAGTAAATAGAGTT
AGGCAGGGATACTCACCTCTGTCATTGCAGACCCCTTATCCCAAGCCCGAGGGGACCAGACAGGCCCGGAGGAATCGA
AGAAGAAGGTGGAGAGCAAGACAGAAACAGATCAACGCGATTAGTGAGCGGATTCTTAGCGCTTGCCTGGGACGACC
TGCGGAGCCTGTGCCTTTTCATCTACCACCGATTGAGAGACTTCATATTAATTGCAGCGAGAGCGGGGGAACTTCTG
GGACGCAGCAGTCTCAAGGGACTACGGAGAGGGTGGGAAGCCCTTAAGTATCTGGGAAGTCTTGTGCAGTATTGGGG
CCTGGAACTAAAAAGGAGTGCTATTAGTCTATTGGATACCCTAGCAATAGCAGTAGGTGAGGGAACAGATAGGATTC
TAGAATTTGTATTAGGAATTTGTAGAGCTATCCGCAACATACCTACAAGAATAAGACAGGGCTTTGAAACAGCTTTG
CTATAA
>703010505.W160.D2
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTAACATGTGGGAAAATGACATGGTGGATCAGATGCATGAAGA
TGTAATTAGTTTATGGGATCAAAGCCTCAAGCCATGTGTAAGGTTGACCCCACTCTGTGTCACTCTAAACTGTATCA
ATGCTACTAATGCTACTGCCAGCGATAGCAGTATATTAGATGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCATGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAGACTTTACAAAGGGT
AAGTGAAAAATTAAAAAAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
ACTAGTACAGATATGGCTAATAGTACAGAAACTAACATCATCACAATCCACTGCAGAATAAAACAAATTATAAACAT
GTGGCAGGAGGTGGGACGAGCAATGTATGCCCCTCCCATTGCAGGAAACATAAACATGTATATCAAATATCACAGGAC
TACTATTGACAAGGGATGGAGGAAACAATACAGAGGATACGGAGACATTCAGACCTGTAGGAGGAAATATGAAGGAC
AATTGGAGCAGTGAATTATATAAATATAAAGTGGTAGAAGTTAAGCCATTAGGAGTAGCACCCCACTAATGCAAGAAG
GAGAGTGGTGGAGAGAGAAAAAAGAGCAGTGGGAATGGGAGCTGTGTTCCTTGGGTTCTTGGGAGCGGCAGGAAGCA
CTATGGGCGCAGCATCAATAACGCTGACGGTACAGGCCAGACAATTATTGTCTGGTATAGTGCAACAGCAAAGCAAT
TTGCTGAAGGCTATAGAGGCTCAACAGCATATGTTGAAACTCACGGTCTGGGGCATTAAACAGCTCCAGGCAAGAGT
CCTGGCCTTGGAAAGATACCTAAAGGATCAACAGCTCCTAGGGATGTGGGGCTGCTCTGGAAAACTCATCTGCACCA
CTAATGTATATTGGAACTCTAGCTGGAGTAATAAAACTTATGATGATATTTGGGATAACATGACCTGGATGCAGTGG
GAGAGAGAAATTAGCAATTATACAGAAATAATATATGACTTGCTTGAAGAATCACAAAACCAGCAGGAAAAGAATGA
ACAAGATTTACTAGCATTGGACAGATGGAATAGTCTGTGGAATTGGTTTAACATAACAAATTGGCTGTGGTATATAA
AAATATTCATAATGATAGTAGGAGGCTTGATAGGTTTAAGAATAATTTTTGCTGTGCTTTCTTTAGTAAATAGAGTT
AGGCAGGGATACTCACCTCTGTCATTGCAGACCCCTTATCCCAAGCCCGAGGGGACCAGACAGGCCCGGAGGAATCGA
AGAAGAAGGTGGAGAGCAAGACAGAAACAGATCAACGCGATTAGTGAGCGGATTCTTAGCGCTTGCCTGGGACGACC
TGCGGAGCCTGTGCCTTTTCATCTACCACCGATTGAGAGACTTCATATTAATTGCAGCGAGAGCGGGGGAACTTCTG
GGACGCAGCAGTCTCAAGGGACTACGGAGAGGGTGGGAAGCCCTTAAGTATCTGGGAAGTCTTGTGCAGTATTGGGG
CCTGGAACTAAAAAGGAGTGCTATTAGTCTATTGGATACCCTAGCAATAGCAGTAGGTGAGGGAACAGATAGGATTC

FIG. 17B cont'd

```
TAGAATTTGTATTAGGAATTTGTAGAGCTATCCGCAACATACCTACAAGAATAAGACAGGGCTTTGAAACAGCTTTG
CTATAA
>703010505.W160.D5
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGGAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGCCAGCGATAGCAGTATATTAGATGGAATGAAAAATTGCTCTTTCAATATAACCACAGAA
TTAAGAGATAAGAGAGAGAAAAAAGAATGCACTTTTTTTATAAACTTGATATAGTACAACTAGGTAGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAAACTTTACAAAGGGT
AAGTGAAAAATTAAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
AATAGTACAGATATGGCTAATAGTACAGAAACTAACAGTACACAAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGACTACTATTGACAAGGGATGGAGGAAACAATACAGAGGGATACGGAGACATTCAGACCTGTAGGAGGAAAT
ATGAAGGACAATTGGAGCAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGTTGGAGTAATAAAACTTATGATGATATTTGGGATAACATGACCTGG
ATGCAATGGGAGAGAGAAATTAGCAATTATACAGAAATAATATATGAATTGCTTGAAGAATCACAAAACCAGCAGGA
AAAGAATGAACAAGATTTACTAGCATTGGACAGATGGAACAGTCTGTGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTACA
GTATTGGGGCCTGGAACTAAAAAGGAGTGCTATTAGTCTATTGGATACCCTAGCAATAGCAGTAGGTGAGGGAACAG
ATAGGATTCTAGAATTTGTATTAGGAATTTGTAGAGCTATCCGCAACATACCTACAAGAATAAGACAGGGCTTTGAA
ACAGCTTTGCTATAA
>703010505.W160.D6
ATGAGAGTGAAGGGGATACAGAGGAATTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGGAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATACTACTGACAGCAATAGCAATATATTAGAGGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTGG
CAACTCTAGTCAGTATAGATTAATAAATTGTAATACCTCAGTCATAACACAAGCCTGTCCAAAGGTCTCTTTTGACC
CAATTCCTATACATTATTGTGCTCCAGCTGGTTATGCGATTCTAAAGTGTAATAATAAGACATTCAATGGAACAGGA
CCGTGTAATAATGTCAGCACAGTACAATGTACACATGGAATTAAGCCAGTGGTTTCAACTCAACTATTGTTAAATGG
TAGCCTAGCAGAAGGAAAGATAATAATTAGGTCTAAAAATATAACAGACAATAGCAAAACAATAATAGTACATCTCA
ATGAATCTGTAAAGATTGAGTGTACGAGACCCAGTAATAACACAAGAACAAGTATAAGAATAGGACCAGGACAAGCA
TTTTATGCAACAGGACAAGTAATAGGAAATATAAGAGAAGCACATTGTAACATTAGTGAAAGTAAATGGAATGAGAC
TTTACAAAGGGTAAGTGAAAAATTAAAAAAATACTTCCCTGATAAGAATATAACATTTCAACCATCCTCAGGAGGGG
ACCTAGAAATTACAACACATAGCTTTAATTGTGGAGGAGAATTTTTCTATTGCAATACATCAAGCCTGTTTAATAGG
ACATATATGGCTACTAGTACAGATATGGCTAATAGTACAGAAACTAACATCATCACAATCCACTGCAGAATAAAACA
AATTATAAACATGTGGCAGGAGGTGGGACGAGCAATGTATGCCCCTCCCATTGCAGGAAACATAACATGTATATCAA
ATATCACAGGACTACTATTGACAAGGGATGGAGGAAACAATACAGAGGATACGGAGACATTCAGACCTGTAGGAGGA
AATATGAAGGACAATTGGAGCAGTGAATTATATAAATATAAAGTGGTAGAAGTTAAGCCATTAGGAGTAGCACCCAC
TAATGCAAGAAGGAGAGTGGTGGAGAGAGAAAAAAGAGCAGTGGGAATGGGAGCTGTGTTCCTTGGGTTCTTGGGAG
CGGCAGGAAGCACTATGGGCGCAGCATCAATAACGCTGACGGTACAGGCCAGACAATTATTGTCTGGTATAGTGCAA
CAGCAAAGCAATTTGCTGAAGGCTATAGAGGCTCAACAGCATATGTTGAAACTCACGGTCTGGGGCATTAAACAGCTC
CAGGCAAGAGTCCTGGCCTTGGAAAGATACCTAAAGGATCAACAGCTCCTAGGGATGTGGGGCTGCTCTGGAAAACT
CATCTGCACCACTAATGTATATTGGAACTCTAGCTGGAGTAATAAAACTTATGATGATATTTGGGATAACATGACCT
GGATGCAGTGGGAGAGAGAAATTAGCAATTATACAAACATAATATATGAATTGCTTGAAGAATCACAAAACCAGCAG
GAAAAGAATGAACAAGATTTACTAGCATTGGACAGATGGAACAGTCTGTGGAATTGGTTTAACATAACAAATTGGCT
GTGGTATATAAAAATATTCATAATGATAGTAGGAGGCTTGATAGGTTTAAGAATAATTTTTGCTGTGCTTTCTTTAG
TAAATAGAGTTAGGCAGGGATACTCACCTCTGTCATTGCAGACCCTTATCCCAAGCCCGAGGGGACCAGACAGGCCC
GGAGGAATCGAAGAAGAAGGTGGAGAGCAAGACAGAAACAGATCAACGCGATTAGTGAGCGGATTCTTAGCGCTTGC
CTGGGACGACCTGCGGAGCCTGTGCCTTTTCATCTACCACCGATTGAGAGACTTCATATTAATTGCAGCGAGAGCGG
GGGAACTTCTGGGACGCAGCAGTCTCAAGGGACTACGGAGAGGGTGGGAAGCCCTTAAGTATCTGGGAAGTCTTGTG
CAGTATTGGGGCCTGGAACTAAAAAGGAGTGCTATTAGTCTATTGGATACCCTAGCAATAGCAGTAGGTAAGGGAAC
```

FIG. 17B cont'd

```
AGATAGGATTCTAGAATTTGTATTAGGAATTTGTAGAGCTATCCGCAACATACCTACAAGAATAAGACAGGGCTTTG
AAACAGCTTTGCTATAA
>703010505.W160.T2
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACGGACCCCAATCCA
CAAGAAATGGTTTTAAAAAAATGTAACAGAAAAATTTCAACATGTGGAAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTATCA
ATGCTACTAATGCTACTGCCAGCGATAGCAGTATATTAGATGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAAACTTTACAAAGGGT
AAGTGAAAAATTAAAAGAATACTTCCCTGATAAGAATATAACATTTCAACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
AATAGTACAGATATGGCTAATAGTACAGAAACTAACAGTACACAAATCATCACAATCCACTGCAGAATAAAACAAAT
TATAAACATGTGGCAGGAGGTGGGACGAGCAATGTATGCCCCTCCCATTGCAGGAAACATAACATGTATATCAAATA
TCACAGGACTACTATTGACAAGGGATGGAGGAAACAATACAGAGGATACGGAGACATTCAGACCTGTAGGAGGAAAT
ATGAAGGACAATTGGAGCAGTGAATTATATAAATATAAAGTGGTAGAAGTTAAGCCATTAGGAGTAGCACCCACTAA
TGCAAGAAGGAGAGTGGTGGAGAGAGAAAAAAGAGCAGTGGGAATGGGAGCTGTGTTCCTTGGGTTCTTGGGAGCGG
CAGGAAGCACTATGGGCGCAGCATCAATAACGCTGACGGTACAGGCCAGACAATTATTGTCTGGTATAGTGCAACAG
CAAAGCAATTTGCTGAAGGCTATAGAGGCTCAACAGCATATGTTGAAACTCACGGTCTGGGGCATTAAACAGCTCCA
GGCAAGAGTCCTGGCCTTGGAAAGATACCTAAAGGATCAACAGCTCCTAGGGATGTGGGGCTGCTCTGGAAAACTCA
TCTGCACCACTAATGTATATTGGAACTCTAGCTGGAGTAATAAAACTTATAGTGATATTTGGGATAACATGACCTGG
ATGCAGTGGGAGAGAGAATAGCAATTATACAGAACTAATATATGAACTGCTTGAAGAATCACAAAACCAGCAGGA
AAAGAATGAACAAGATTTACTAGCATTGGACAGATGGAACAGTCTATGGAATTGGTTTAACATAACAAATTGGCTGT
GGTATATAAAAATATTCATAATGATAGTAGGAGGCTTGATAGGTTTAAGAATAATTTTTGCTGTGCTTTCTTTAGTA
AATAGAGTTAGGCAGGGATACTCACCTCTGTCATTGCAGACCCTTATCCCAAGCCCGAGGGGACCAGACAGGCCCGG
AGGAATCGAAGAAGAAGGTGGAGAGCAAGACAGAAACAGATCAACGCGATTAGTGAGCGGATTCTTAGCGCTTGCCT
GGGACGACCTGCGGAGCCTGTGCCTTTTCATCTACCACCGATTGAGAGACTTCATATTAATTGCAGCGAGAGCGGGG
GAACTTCTGGGACGCAGCAGTCTCAAGGGACTACGGAGAGGGTGGGAAGCCCTTAAGTATCTGGGAAGTCTTGTGCA
GTATTGGGGCCTGGAACTAAAAAGGAGTGCTATTAGTCTATTGGATACCCTAGCAATAGCAGTAGGTGAGGGAACAG
ATAGGATTCTAGAATTTGTATTAGGAATTTGTAGAGCTATCCGCAACATACCTACAAGAATAAGACAGGGCTTTGAA
ACAGCTTTGCTATAA
>703010505.W160.T3
ATGAGAGTGAGGGGGATACAGAGGAGTTATCCACAATGGTGGATATGGAGCATGTTAGGCTTTTGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGGAAAATGACATGGTGGATCAGATGCATGAAGA
TGTAATTAGTTTATGGGATCAAAGCCTCAAGCCATGTGTAAAGTTGACTCCACTCTGTGTCACTCTAAACTGTATCA
ATGCTACTAATGCTACTGCCAGCGATAGCAGTATATTAGATGGAATGAAAAATTGCTCTTTCAATATAACCACAGAA
TTAAGAGATAAGAGAGAGAAAAAGAATGCACTTTTTTATAAACTTGATATAGTACAACTAGGTGGCAACTCTAGTCA
GTATAGATTAATAAATTGTAATACCTCAGTCATAACACAAGCCTGTCCAAAGGTCTCTTTTGACCCAATTCCTATAC
ATTATTGTGCTCCAGCTGGTTATGCGATTCTAAAGTGTAATAATAAGACATTCAATGGAACAGGACCGTGTAATAAT
GTCAGCACAGTACAATGTACACATGGAATTAAGCCAGTGGTTTCAACTCAACTATTGTTAAATGGTAGCCTAGCAGA
AGGAGAGATAATAATTAGATCTAAAAATATAACAGACAATAGCAAAACAATAATAGTACATCTCAATGAATCTGTAA
AGATTGAGTGTACGAGACCCAGTAATAACACAAGAACAAGTATAAGAATAGGACCAGGACAAGCATTTTATGCAACA
GGACAAGTAATAGGAAATATAAGAGAAGCACATTGTAACATTAGTGAAAGTAAATGGAATGAGACTTTACAAAGGGT
AAGTGAAAAATTAAAAAAATACTTCCCTGATAAGAATATAACATTTCGACCATCCTCAGGAGGGGACCTAGAAATTA
CAACACATAGCTTTAATTGTGGAGGAGAATTTTTCTATTGCAATACATCAAGCCTGTTTAATAGGACATATATGGCT
ACTAGTACAGATATGGCTAATAGTACAGAAACTAACATCATCACAATCCACTGCAGAATAAAACAAATTATAAACAT
GTGGCAGGAGGTGGGACGAGCAATGTATGCCCCTCCCATTGCAGGAAACATAACATGTATATCAAATATCACAGGAC
TACTATTGACAAGGGATGGAGGAAACAATACAGAGGATACGGAGACATTCAGACCTGTAGGAGGAAATATGAAGGAC
AATTGGAGCAGTGAATTATATAAATATAAAGTGGTAGAAGTTAAGCCATTAGGAGTAGCACCCACTAATGCAAGAAG
GAGAGTGGTGGAGAGAGAAAAAAGAGCAGTGGGAATGGGAGCTGTGTTCCTTGGGTTCTTGGGAGCGGCAGGAAGCA
CTATGGGCGCAGCATCAATAACGCTGACGGTACAGGCCAGACAATTATTGTCTGGTATAGTGCAACAGCAAAGCAAT
TTGCTGAAGGCTATAGAGGCTCAACAGCATATGTTGAAACTCACGGTCTGGGGCATTAAACAGCTCCAGGCAAGAGT
CCTGGCCTTGGAAAGATACCTAAAGGATCAACAGCTCCTAGGGATGTGGGGCTGCTCTGGAAAACTCATCTGCACCA
CTAATGTATATTGGAACTCTAGTTGGAGTAATAAAACTTATGATGATATTTGGGATAACATGACCTGGATGCAGTGG
GAGAGAGAAATTAGCAATTATACAGAACTAATATATGAATTGCTTGAAGAATCACAAAACCAGCAGGAAAAGAATGA
ACAAGATTTACTAGCATTGGACAGATGGAACAGTCTGTGGAATTGGTTTAACATAACAAATTGGCTGTGGTATATAA
AAATATTCATAATGATAGTAGGAGGCTTGATAGGTTTAAGAATAATTTTTGCTGTGCTTTCTTTAGTAAATAGAGTT
AGGCAGGGATACTCACCTCTGTCATTGCAGACCCTTATCCCAAGCCCGAGGGGACCAGACAGGCCCGGAGGAATCGA
AGAAGAAGGTGGAGAGCAAGACAGAAACAGATCAACGCGATTAGTGAGCGGATTCTTAGCGCTTGCCTGGGACGACC
TGCGGAGCCTGTGCCTTTTCATCTACCACCGATTGAGAGACTTCATATTAATTGCAGCGAGAGCGGGGAACTTCTG
GACGCAGCAGTCTCAAGGACTACGGAGAGGGTGGGAAGCCCTTAAGTATCTGGGAAGTCTTGTGCAGTATTGGGG
CCTGGAACTAAAAAGGAGTGCTATTAGTCTATTGGATACCCTAGCAATAGCAGTAGGTGAGGGAACAGATAGGATTC
```

FIG. 17B cont'd

TAGAATTTGTATTAGGAATTTGTAGAGCTATCCGCAACATACCTACAAGAATAAGACAGGGCTTTGAAACAGCTTTG
CTATAA
>703010505.W160.T4
ATGAGAGTGATGGGGAGACAGAGGAATTATCCACAATGGTGGATATGGAGCACGTTAGGCTTGCGGATGCTAATGAT
TTGTAATGGGATGTGGGTCACAGTCTACTATGGGGTACCTGTGTGGAAAGAAGCAAAAACTACTCTATTTTGTGCAT
CAGATGCTAAAGCATATGAGAAAGAAGTGCATAATGTCTGGGCTACACATGCCTGTGTACCCACAGACCCCAATCCA
CAAGAAATGGTTTTAAAAAATGTAACAGAAAATTTCAACATGTGGGAAAATGACATGGTGGATCAGATGCATGAAGA
TGTAATTAGTTTATGGGATCAAAGCCTCAAGCCATGTGTAAAGTTGACCCCACTCTGTGTCACTCTAAACTGTACCG
ATGCTAATGCTACTGCCAGCAATGCTAATGCTACTGTCAGCAATACCAATGCTACTGTCAGCAATGATAGCAGTATA
ATAGAGGAAATGAAAAATTGCTCTTTCAATATAACCACAGAATTAAGAGATAAGATAGAGAAAAAGTATGCACTTTT
TTATAAACTTGATATAGTACAACTAGATGGCAACTCTACTCATTATAGATTCATAAATTGTAATACCTCAGCCATAA
CACAAGCCTGTCCAAAGGTCTCTTTTGACCCAATTCCTATACATTATTGTGCTCCAGCTGGTTATGCGATTCTAAAG
TGTAATAATAAGACATTCAATGGAACAGGACCGTGTAATAATGTCAGCACAGTACAATGTACACATGGAATTAAGCC
AGTGGTTTCAACTCAACTATTGTTAAATGGTAGCCTAGCAGAAGGAGAGATAATAATTAGATCTGAAAATATAACAG
ACAATGCCAAAACAATAATAGTACATCTCAATGAATCTGTAAAGATTGAGTGTACGAGACCCAGTAATAACACAAGA
ACAAGTATAGGAATAGGACCAGGACAAGCATTTTATGCAACAGGACAAGTAATAGGAGACATAAGAAAAGCACATTG
TAACATTAGTGAAAGTAAATGGAATGAAACTTTACAAAGGGTAAGTAAAAAATTAAAAGAATACTTCCCTGGTAAGA
ATATAACATTTCAACCATCCTCAGGAGGGGACCCAGAAGTTACAACACATAGCTTTAATTGTGGAGGAGAATTTTTC
TATTGCAATACATCAAGCCTGTTTAATAGGACATATATGACTAATAGTACAGATATGGCTAATAGTACAGAAACTAA
CAGAACCATCACAATCCACTGCAGAATAAAACAAATTATAAACATGTGGCAAGAGGTGGGACGAGCAATGTATGCCC
CTCCCATTGCAGGAAACATAACATGTATATCAAATATCACAGGACTACTATTGACAAGGGATGGAGGAAACAATACG
GATCCGGAGATATTCAGACCTGGAGGAGGAAATATGAAGGACAATTGGAGAAGTGAATTATATAAATATAAAGTGGT
AGAAGTTAAGCCATTAGGAGTAGCACCCACTAATGCAAGAAGGAGAGTGGTGGAGAGAGAAAAAAGAGCAGTGGGAA
TGGGAGCTGTGTTCCTTGGGTTCTTGGGAGCGGCAGGAAGCACTATGGGCGCAGCGTCAATAACGCTGACGGTACAG
GCCAGACAACTATTGTCTGGTATAGTGCAACAGCAAAGCAATTTGCTGAAGGCTATAGAGGCTCAACAGCACATGTT
GAGACTCACGGTCTGGGGCATTAAACAGCTCCAGGCAAGAGTCCTGGCCTTGGAAAGATACCTAAAGGATCAACAGC
TCCTAGGGATGTGGGGCTGCTCTGGAAAACTCATTTGCACCACTAATGTATATTGGAACTCTAGTTGGAGTAATAAA
ACTTATGGTGATATTTGGGATAACATGACCTGGATGCAGTGGGAGAGCGAAATTAGCAATTACAAACATAATATA
TGATTTGCTTGAAGAATCACAAAACCAGCAGGAAAAGAATGAACAAGATTTACTAGCATTGGACAGATGGAACAGTC
TGTGGAATTGGTTTAACATAACAAAATGGCTGTGGTATATAAAAATATTCATAATGATAGTAGGAGGCTTGATAGGT
TTAAGAATAATTTTTGCTGTGCTTTCTTTAGTAAATAGAGTTAGGCAGGGATACTCACCTCTGTCGTTGCAGACCCT
TATCCCAAGCCCGAGGGGACCAGACAGGCCCGGAGGAATCGAAGAAGAAGGTGGAGAGCAAGACAGAAAGAGATCAA
CGCGATTAGTGAGCGGATTCTTAGCGCTTGTCTGGGACGACCTGCGGAGCCTGTGCCTTTTCCTCTACCACCGATTG
AGAGACTTCATATTAATTGCAGCGAGAGCGGGGGAACTTCTGGGACGCAGCAGTCTCAAGGGACTACGGAGAGGGTG
GGAAGCCCTTAAGTATCTGGGAAGTCTTGTGCAGTATTGGGGCCTGGAACTAAAAAGGAGTGCTATTAGTCTATTGG
ATACCCTAGCAATAGCAGTAGGTGAAGGAACAGATAGGATTCTAGAATTTGTATTAGGAATTTGTAGAGCTATCCGC
AACATACCTACAAGAATAAGACAGGGCTTTGAAACAGCTTTGCTATAA

FIG. 18

Antibody-Virus Co-Evolution in
Acutely Infected Patients Followed
To BnAb Induction

FIG. 18 cont'd

Neutralization analysis of 3 CH505
HIV-specific mAbs: CH103, CH104, CH106

| | Virus ID | Clade | IC₅₀ values (µg/ml) | | | | |
|---|---|---|---|---|---|---|---|
| | | | CH505 mAbs | | | | |
| | | | CH103 VH4-59 | CH104 VH4-59 | CH106 VH4-59 | VRC01 VH1-2 | |
| Viruses used for screening | JRFL.JB | B | 0.055 | 0.017 | 0.010 | 0.010 | |
| | HXB2.DG | B | 0.032 | 0.004 | 0.004 | 0.009 | |
| | SF162.LS | B | 0.219 | 0.047 | 0.045 | 0.065 | |
| | 7165.18 | B | >50 | >50 | >50 | >50 | VRC01= 84% |
| | BG1168.01 | B | 12.4 | 6.69 | 10.4 | 0.315 | |
| | CAA.A2 | B | >50 | >50 | >50 | 0.989 | |
| | JR-CSF | B | 0.326 | 0.142 | 0.256 | 0.102 | |
| | PVO.4 | B | >50 | >50 | 10.9 | 0.355 | CH103= 55% |
| | TRO.11 | B | 1.60 | 18.86 | 2.93 | 0.309 | |
| | YU2.DG | B | 1.05 | 0.861 | 0.598 | 0.083 | |
| | KER2008.12 | A | >50 | >50 | >50 | 0.488 | |
| | KER2018.11 | A | 41.2 | >50 | >50 | 0.443 | |
| | Q23.17 | A | 4.90 | >50 | >50 | 0.034 | |
| | Q168.a2 | A | 1.64 | 3.04 | 3.11 | 0.076 | |
| | UG037.8 | A | 0.765 | 6.29 | 4.46 | 0.064 | |
| | Q842.d12 | A | 0.340 | 1.00 | 0.413 | 0.012 | |
| | UG037.8 | A | 0.765 | 6.29 | 4.46 | 0.064 | |
| | DU156.12 | C | >50 | >50 | >50 | 0.057 | |
| | SO18.18 | C | 0.834 | 0.698 | 0.671 | 0.025 | |
| | TV1.29 | C | >50 | >50 | >50 | >50 | |
| | ZM106.9 | C | 3.93 | 14.8 | 10.9 | 0.206 | |
| | ZM109.4 | C | 18.2 | >50 | >50 | 0.004 | |
| | ZM176.66 | C | 0.031 | >50 | >50 | 0.016 | |
| | MuLV | non-HIV specific | >50 | >50 | >50 | >50 | |
| | SIVmac251.30 | non-HIV specific | >50 | >50 | >50 | >50 | |

Pieces of the Puzzle

- Antibody envelope structure
- Viral sequences over time
- Antibody clonal lineage

FIG. 18 cont'd

Within-sample entropy by position

Exceptional within-sample diversity is concentrated in CH103 and CD4 contact regions, V1 and V5

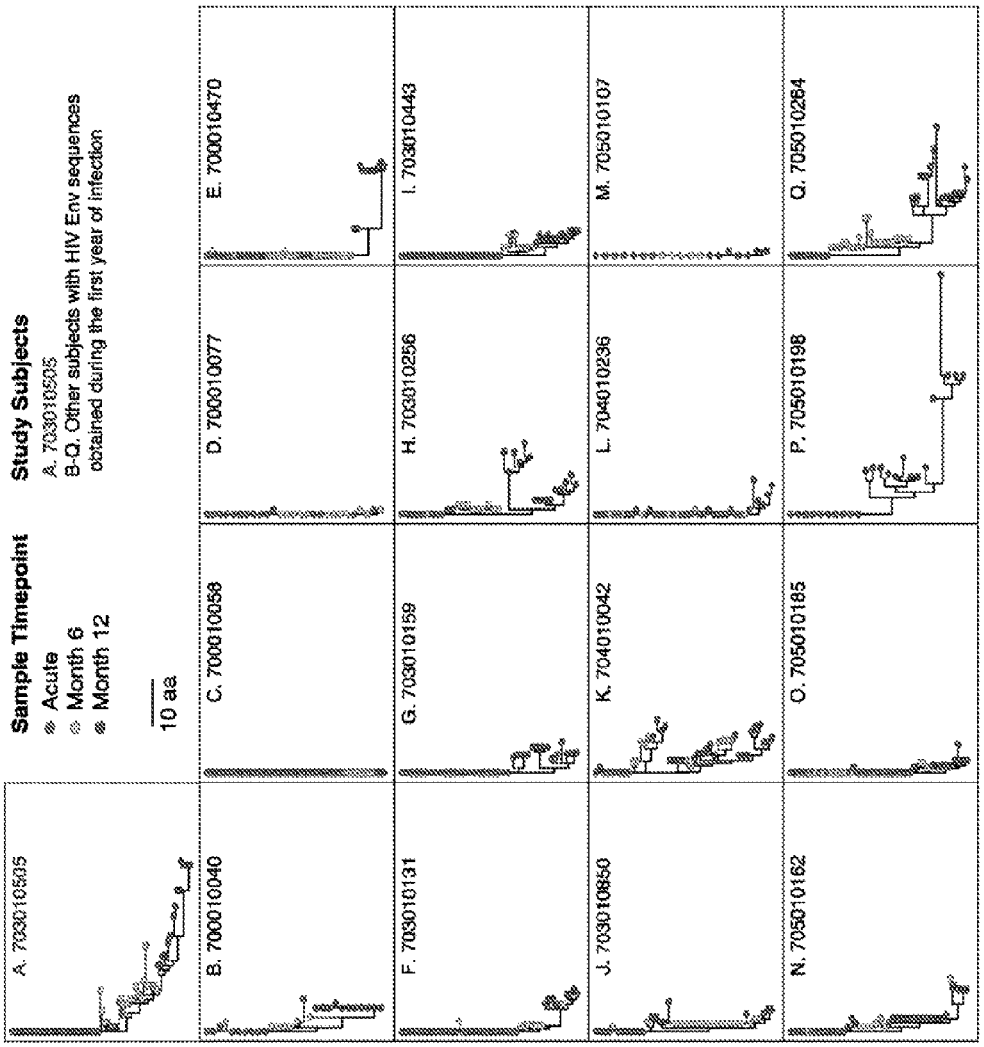
FIG. 18 cont'd  (B)
The diversity by 6 months in the CD4 binding region was greatest for CH505 among 17 subjects followed from acute infection.

FIG. 18 cont'd

Evolutionary Trajectory

1. The CH103 lineage began by binding the T/F

2. Autologous Neutralization evolved (through somatic mutation and affinity maturation)

3. Escape from neutralization drove rapid (clearly by 20 weeks) accumulation of variation in the epitope 4. Population breadth followed this diversification, so presumably the antibody lineage evolved to tolerate the diversity generated by early escape 5. The epitope was continuing to evolve at the time CH103 was sampled, potentially better antibodies could be identified

FIG. 18 cont'd

Affinity and kinetics of CH103 UCAs binding to autologous T/F CH505 gp140[a].

[a] SPR binding rate constants and dissociation constant ($K_d$) was measured with each antibody captured on an anti-IgG (Fc specific) antibody surface and CH505 gp140 was injected in solution at concentrations ranging from 2 to 100 ug/mL. Data are representative of at least two independent measurements.

| CH103UCAs | Binding affinity to autologous Envs | | |
|---|---|---|---|
| | $k_a$ (× $10^3$ $M^{-1}s^{-1}$) | $k_d$, (× $10^{-3}$ $s^{-1}$) | $K_d$, nM |
| CH103UCA-1 | 26.7 | 0.926 | 37.5 |
| CH103UCA-2,3,5[b] | 20.5 | 2.9 | 141.5 |
| CH103UCA-4 | 27.2 | 1.0 | 36.8 |
| CH103UCA-6 | 25.0 | 6.6 | 264.0 |

FIG. 18 cont'd

Hypothesis: Escape from BnAbs occurs early at 30 weeks and maybe 14 weeks, meaning BnAbs may be present and able to exert immune pressure at very low levels before they appear in plasma

Combined Dataset of Evolution of Virus Sequences and Neutralization of Evolved Transmitted/Founder Vari

FIG. 18 cont'd

What is a potential strategy to overcome host constraints of BnAb induction?

FIG. 18 cont'd

Goals of B Lineage Design

- Drive broad neutralizing lineages

- Drive shorter lineages with fewer mutations

- Drive lineages with either no auto-reactivity or "acceptable autoreactivity"
- Give lineages that are normally "subdominant" the ability to compete and become "dominant"

Haynes, B, Harrison, S, Kelsoe, G and Kepler T, Nature Biotech. 30: 423, 2012

FIG. 18 cont'd

Strategies for Choice of Immunogens

- Based on affinity of evolved Env binding for UCA and IAs

FIG. 18 cont'd    Analysis of CH0505 Envelopes From Weeks 24, 48, 72 and 96 for Binding to CH103 Clonal Lineage Members (EC50 ug/ml)

| CH0505 Envs | UCA | IA8 | IA4 | IA3 | IA2 | IA1 | CH105.2 | CH103 | CH104 | CH106 |
|---|---|---|---|---|---|---|---|---|---|---|
| CH0505 T/F | 2.0 | 1.1 | 0.3 | 0.12 | 0.09 | 0.11 | 0.1 | 0.08 | 0.12 | 0.08 |
| CH505.s.03 | 1.2 | 0.63 | 0.7 | 0.08 | 0.05 | 0.05 | 0.06 | 0.06 | 0.07 | 0.04 |
| CH505.08 | >10 | 1.2 | 0.53 | 0.22 | 0.14 | 0.46 | 0.33 | 0.23 | 0.32 | 0.16 |
| CH505.w30.e6 | NB | >10 | 2.1 | 0.07 | 0.047 | 0.06 | 0.064 | 0.055 | 0.05 | 0.05 |
| CH0505.w30.Env23 | NB | NB | >20 | 0.14 | 0.07 | 0.09 | 0.08 | 0.044 | 0.07 | 0.053 |
| CH505.w53.e16 | NB | NB | NB | 0.066 | 0.03 | 0.05 | 0.05 | 0.03 | 0.036 | 0.032 |
| CH505.w78.env1 | NB | NB | NB | 0.26 | 0.14 | 0.2 | 0.21 | 0.06 | 0.17 | 0.26 |
| CH505.w78.env7 | NB | NB | NB | 0.13 | 0.054 | 0.083 | 0.09 | 0.043 | 0.1 | 0.13 |
| CH505.w78.env16 | NB | NB | NB | 0.39 | 0.2 | >10 | 0.3 | 1.2 | 0.19 | 0.14 |
| CH505.w78 env25 | NB | NB | NB | 0.44 | 0.17 | 0.25 | 0.29 | 0.096 | 0.18 | 0.16 |
| CH505.w78.env33 | NB | NB | NB | >100 | 0.045 | 0.15 | 0.04 | 0.03 | 0.25 | 0.16 |
| CH505.w78.env38 | NB | NB | >100 | >100 | >100 | >10 | >10 | >10 | >10 | >10 |
| CH505.w100.A4 | NB | NB | NB | 0.074 | 0.029 | 0.037 | 0.07 | 0.03 | 0.033 | 0.043 |
| CH505.w100.B6 | NB | NB | NB | 0.013 | 0.007 | 0.01 | 0.01 | 0.06 | 0.009 | 0.01 |

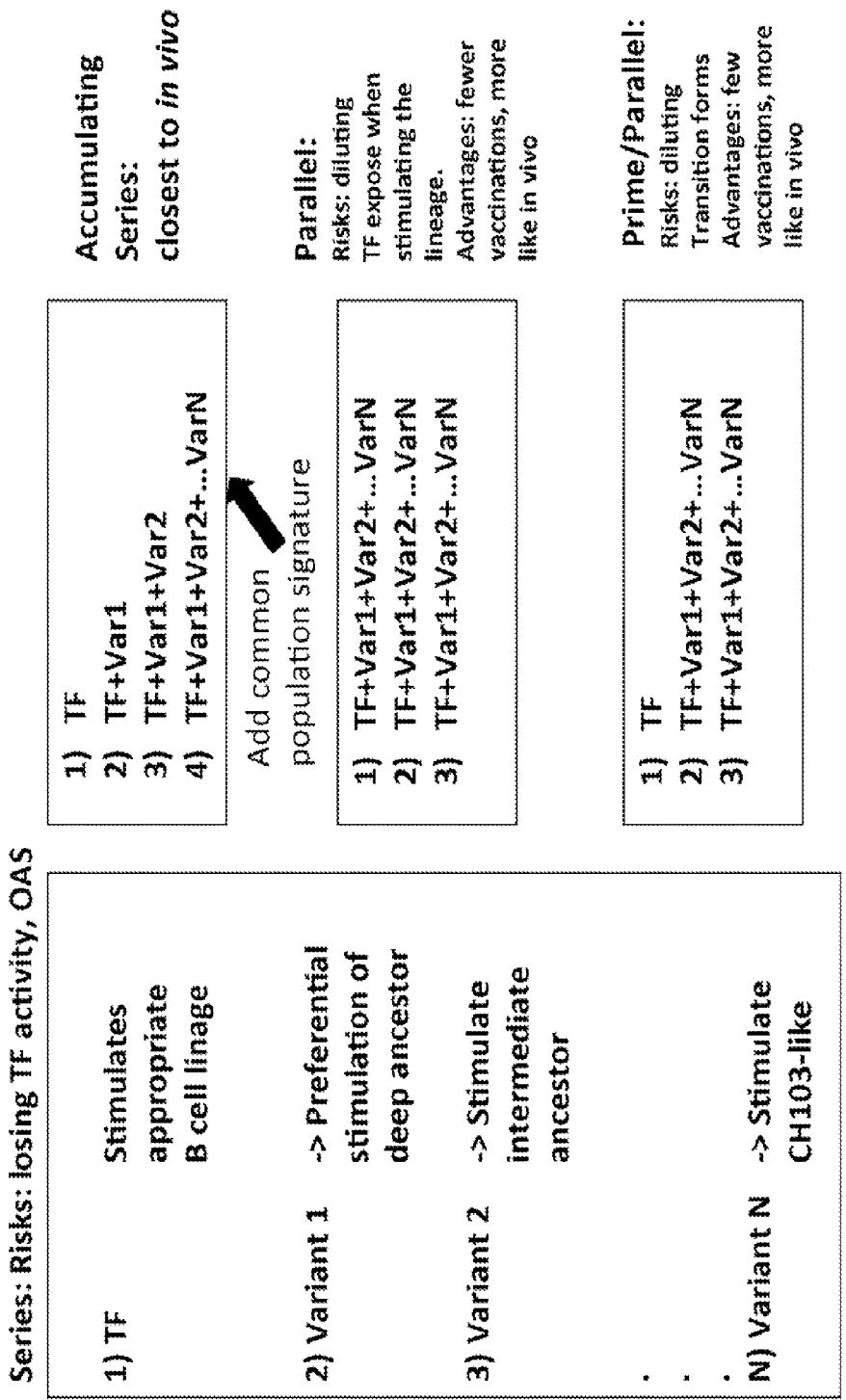

FIG. 18 cont'd

Conclusions

- Map both virus and antibody evolution from the time of transmission to define the envelope changes that induce several types of bnAbs.
- Recreate this scenerio with a vaccine + strong adjuvant.
- Key to study AHI through BnAb development-Autologous Envs bind germline BCRs.

CB505_T/F       TDNAKSTETNSTRTITIHCPIKQIINMWQKVGRAMYAPPIAGNITCISNITGLLLTRDGGKNNT......ETPRPGGGN
w4.03           ------------------------------------------------------------------,,,,---------
w4.26           ------------------------------------------------------------------,,,,---------
TF.M6           ------------------------------------------------------------------,,,,---------
TF.M10          ------------------------------------------------------------------,,,,---------
TF.M11          ------------------------------------------------------------------,,,,---------
w20.14          --------------L---------------------------------------------------,,,,---------
w30.28          ---------------R--------------------------------------------------,,,,---------
w53.16          ----------I---R-------------------------------------------------ETP----------
w53.31          ,,--------I---R--------------------------------------------N-----,,,,---------
w78.7           ----------I---R--------------------------------------------E-----ETP----------
w78.15          ----------I---R----------------------------------------------D---,,D-----E---
w78.25          ----------I---R-------------------------------------------------ETP----------
w78.33          ,,-----------L-------------------------------------------N----,,T-----------
w100.A4         ,,------------S----------------------------------------------D---,,DT----S---
w100.B4         ----------I---R-----------------------------------------------NSS-,,,,---S---
w100.B6         ,,------------L---------------------------------------E-IRDGGNKNT-----K---   480

CB505_T/F       MRDNWRSELYKYKVVEVKPLGVAPTNARREVVEREKRAVGMGAVFLGFLGAAGSTMGAASITLTVQARQLLSGIVQQQSN
w4.03           -------------------------------------------------------------------------------
w4.26           ---------------------V---------------------------------------------------------
TF.M6           -------------------------------------------------------------------------------
TF.M10          -------------------------------------------------------------------------------
TF.M11          -------------------------------------------------------------------------------
w20.14          -------------------------------------------------------------------------------
w30.28          -------------------------------------------------------------------------------
w53.16          -------------------------------------------------------------------------------
w53.31          -------------------------------------------------------------------------------
w78.7           -------------------------------------------------------------------------------
w78.15          -------------------------------------------------------------------------------
w78.25          -------------------------------------------------------------------------------
w78.33          ---------------------------I---------------------------------------------------
w100.A4         -------------------------------------------------------------------------------
w100.B4         -------------------------------------------------------------------------------
w100.B6         -------------K-----------------------------------------------------------------   560

CB505_T/F       LLKAIEAQQHMLKLTVWGIKQLQARVLALERYLKDQQLLGMWGCSGKLICTTNVYWNSSWSNKTYGDIWDNMTWMQWERE
w4.03           -------------------------------------------------------------------------------
w4.26           -------------------------------------------------------------------------------
TF.M6           -------------------------------------------------------------------------------
TF.M10          -------------------------------------------------------------------------------
TF.M11          -------------------------------------------------------------------------------
w20.14          -------------------------------------------------------------------------------
w30.28          ----------------------------------------------------------S--------------------
w53.16          -------------------------------------------------------------------------------
w53.31          ---------G---------------------------------------------------------------------
w78.7           -------------------------------------------------------------------------------
w78.15          -------------------------------------------------------------------------------
w78.25          -------------------------------------------------------------------------------
w78.33          -------------------------------------------------------------------------------
w100.A4         -------------------------------------------------------------------------------
w100.B4         ------------------------------------------------------------D------------------
w100.B6         -------------------------------------------------------------------------------   640

CB505_T/F       ISNYTKLIYELLEESQNQQEKNEQDLLALDKWASLWNWFNITNWLWYIKIFIMIVGGLIGLRIIFAVLSIVNRVRQGYSP
w4.03           -----------------------------------G-------------------------------------------
w4.26           -------------------------------------------------------------------------------
TF.M6           -------------------------------------------------------------------------------
TF.M10          -------------------------------------------------------------------------------
TF.M11          -------------------------------------------------------------------------------
w20.14          -------------------------------------------------------------------------------
w30.28          -------------------------------------------------------------------------------
w53.16          -------------------------------------------------------------------------------
w53.31          -------M-----------------------------------------------------------------------
w78.7           -------L---------------------------D-------------------------------------------
w78.15          -------L-----------------------------------------------------------------------
w78.25          -------N--------------------------K--------------------------------------------
w78.33          -----D-------------------------------------------------------------------------
w100.A4         -----D-------------------------------------------------------------------------
w100.B4         ------M--D-------------------------K-------------------------------------------
w100.B6         -----D--D--------------------------K-------------------------------------------   720

CB505_T/F       LSLQTLIPSPRGPDRPGGIEEEGGEQDRNRSTRLVSGFLALVWDDLRSLCLFIYHRLRDFILIAARAGELLGRSSLKGLR
w4.03           -------------------------------------------------------------------------------
w4.26           -------------------------------------------------------------------------------
TF.M6           -------------------------------------------------------------------------------
TF.M10          -------------------------------------------------------------------------------
TF.M11          -------------------------------------------------------------------------------
w20.14          -------------------------------------------------------------------------------
w30.28          -------------------------------------------------------------------------------
w53.16          ----------------------------------------------------------A--------------------
w53.31          --------------------------------K-------------------------A--------------------
w78.7           ----------------------------------------------------------A--------------------
w78.15          ----------------------------------------------------------A--------------------
w78.25          --------------------------------R-------------------------A--------------------
w78.33          ------T---------------------------------------------------A--------------------
```

CH505_T/F    RGWEALKYLGSLVQYWGLELKRSAISLLDTLAIAVGEGTDRILSPVLGICRAIRNIPTRIRQGFETALL
w4.03        ---------------------------------------------------------------------
w4.28        ---------------------------------------------------------------------
TF.M6        ---------------------------------------------------------------------
TF.M10       ---------------------------------------------------------------------
TF.M11       ---------------------------------------------------------------------
w20.14       ---------------------------------------------------------------------
w30.28       ---------------------------------------------------------------------
w53.16       ---------------------------------------------------------------------
w53.31       ------------------------------------A--------------------------------
w78.7        ---------------------------------------------------------------------
w78.15       -----------N---------------------------------------------------------
w78.25       ---------------R--------------------A-R-------M----------------------
w78.33       -----------G---------------------------------------------------------
w100.A4      ---------------------------------------------------------------------
w100.B4      ---------------------------------------------------------------------
w100.B6      -----------G------------------------------------------------------ 800
```

FIG. 19B

```
>CB505_T/F
MRVMGIQRNYPQWWIWSMLGFWMLMICNGMWVTVYYGVPVWKEAKTTLFCASDAKAYEKE
VHNVWATHACVPTDPNPQEMVLKNVTENFNMWKNDMVDQMHEDVISLWDQSLKPCVKLTP
LCVTLNCTNATASNSSIIEGMKNCSFNITTELRDKREKKNALFYKLDIVQLDGNSSQYRL
INCNTSVITQACPKVSFDPIPIHYCAPAGYAILKCNNKTFTGTGPCNNVSTVQCTHGIKP
VVSTQLLLNGSLAEGEIIIRSENITNNVKTIIVHLNESVKIECTRPNNKTRTSIRIGPGQ
AFYATGQVIGDIREAYCNINESKWNETLQRVSKKLKEYFPHKNITFQPSSGGDLEITTHS
FNCGGEFFYCNTSSLFNRTYMANSTDMANSTETNSTRTITIHCRIKQIINMWQEVGRAMY
APPIAGNITCISNITGLLLTRDGGKNNTETFRPGGGNMKDNWRSELYKYKVVEVKPLGVA
PTNARPRVVEREKRAVGMGAVFLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWNSLWNWFNITN
WLWYIKIFIMIVGGLIGLRIIFAVLSLVNRVRQGYSPLSLQTLIPSPRGPDRPGGIEEEG
GEQDRNRSTPLVSGFLALVWDDLRSLCLFIYHRLRDFILIAARAGELLGRSSLKGLPRGW
EALKYLGSLVQYWGLELKRSAISLLDTLAIAVGEGTDRILEFVLGICRAIRNIPTRIRQG
FETALL
>w4.03
MRVMGIQRNYPQWWIWSMLGFWMLMICNGMWVTVYYGVPVWKEAKTTLFCASDAKAYEKE
VHNVWATHACVPTDPNPQEMVLKNVTENFNMWKNDMVDQMHEDVISLWDQSLKPCVKLTP
LCVTLNCTNATASNSSIIEGMKNCSFNITTELRDKREKKNALFYKLDIVQLDGNSSQYRL
INCNTSVITQACPKVSFDPIPIHYCAPAGYAILKCNNKTFTGTGPCNNVSTVQCTHGIKP
VVSTQLLLNGSLAEGEIIIRSENITNNVKTIIVHLNESVKIECTRPNNKTRTSIRIGPGQ
AFYATGQVIGDIREAYCNINESKWNETLQRVSKKLKEYFPHKNITFQPSSGGDLEITTHS
FNCGGEFFYCNTSSLFNRTYMANSTDMANSTETNSTRTITIHCRIKQIINMWQEVGRAMY
APPIAGNITCISNITGLLLTRDGGKNNTETFRPGGGNMKDNWRSELYKYKVVEVKPLGVA
PTNARRRVVEREKRAVGMGAVFLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWNSLWNWFNITN
WLGYIKIFIMIVGGLIGLRIIFAVLSLVNRVRQGYSPLSLQTLIPSPRGPDRPGGIEEEG
GEQDRNRSTRLVSGFLALVWDDLRSLCLFIYHRLRDFILIAARAGELLGRSSLKGLPRGW
EALKYLGSLVQYWGLELKRSAISLLDTLAIAVGEGTDRILEFVLGICRAIRNIPTRIRQG
FETALL
>w4.26
MRVMGIQRNYPQWWIWSMLGFWMLMICNGMWVTVYYGVPVWKEAKTTLFCASDAKAYEKE
VHNVWATHACVPTDPNPQEMVLKNVTENFNMWKNDMVDQMHEDVISLWIQSLKPCVKLTP
LCVTLNCTNATASNSSIIEGMKNCSFNITTELRDKREKKNALFYKLDIVQLDGNSSQYRL
INCNTSVITQACPKVSFDPIPIHYCAPAGYAILKCNNKTFTGTGPCNNVSTVQCTHGIKP
VVSTQLLLNGSLAEGEIIIRSENITNNVKTIIVHLNESVKIECTRPNNKTRTSIRIGPGQ
AFYATGQVIGDIREAYCNINESKWNETLQRVSKKLKEYFPHKNITFQPSSGGDLEITTHS
FNCGGEFFYCNTSSLFNRTYMANSTDMANSTETNSTRTITIHCRIKQIINMWQEVGRAMY
APPIAGNITCISNITGLLLTRDGGKNNTETFRPGGGNMKDNWRSELYKYKVVEVKPLGVA
PTNVRRRVVEPEKRAVGMGAVFLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWNSLWNWFNITN
WLWYIKIFIMIVGGLIGLRIIFAVLSLVNRVRQGYSPLSLQTLIPSPRGPDRPGGIEEEG
GEQDRNRSTRLVSGFLALVWDDLRSLCLFIYHRLPDFILIAARAGELLGRSSLKGLRRGW
EALKYLGSLVQYWGLELKRSAISLLDTLAIAVGEGTDRILEFVLGICRAIRNIPTRIRQG
FETALL
>TF.MG
MRVMGIQRNYPQWWIWSMLGFWMLMICNGMWVTVYYGVPVWKEAKTTLFCASDAKAYEKE
VHNVWATHACVPTDPNPQEMVLKNVTENFNMWKNDMVDQMHEDVISLWDQSLKPCVKLTP
LCVTLNCTNATASNSSIIEGMKNCSFNITTELRDKREKKNALFYKLDIVQLDGNSSQYRL
INCNTSVITQACPKVSFDPIPIHYCAPAGYAILKCNNKTFTGTGPCNNVSTVQCTHGIKP
VVSTQLLLNGSLAEGEIIIRSENITNNAKTIIVHLNESVKIECTRPNNKTRTSIRIGPGQ
AFYATGQVIGDIREAYCNINESKWNETLQRVSKKLKEYFPHKNITFQPSSGGDLEITTHS
FNCGGEFFYCNTSSLFNRTYMANSTDMANSTETNSTRTITIHCRIKQIINMWQEVGRAMY
APPIAGNITCISNITGLLLTRDGGKNNTETFRPGGGNMKDNWRSELYKYKVVEVKPLGVA
PTNARRRVVEPEKRAVGMGAVFLGFLGAAGSTMGAASITLTVQARQLLSGIVQQQSNLLK
AIEAQQHMLKLTVWGIKQLQAPVLALERYLKDQQLLGMWGCSGKLICTTNVYWNSSWSNK
TYGDIWDNMTWMQWEREISNYTEIIYELLEESQNQQEKNEQDLLALDRWNSLWNWFNITN
WLWYIKIFIMIVGGLIGLRIIFAVLSLVNRVRQGYSPLSLQTLIPSPRGPDRPGGIEEEG
```

FIG. 19B cont'd

```
GEQDRNRSTRLVSGFLALVWDDLRSLCLFTYHRLRDFILIAARAGELLGRSSLKGLRRGW
EALKYLGSLVQYWGLELKRSAISLLDTLAIAVGEGTDRILEFVLGICRAIRNIPTRIRQG
FETALL
>TF.M10
MRVMGIQRNYPQWWIWSMLGFWMLMICNGMWVTVYYGVPVWKEAKTTLFCASDAKAYEKE
VHNVWATHACVPTDPNPQEMVLKNVTENFNMWKNDMVDQMHEDVISLWDQSLKPCVKLTP
LCVTLNCTNATASNSSIIEGMKNCSFNITTELRDKREKKNALFYKLDIVQLDGNSSQYRL
INCNTSVITQACPKVSFDPIPIHYCAPAGYAILKCNNKTFTGTGPCNNVSTVQCTHGIKP
VVSTQLLLNGSLAEGEIIIRSENITNNGKTIIVHLNESVKIECTRPNNKTRTSIRIGPGQ
AFYATGQVIGDIREAYCNINESKWNETLQRVSKKLKEYFPHKNITFQPSSGGDLEITTHS
FNCGGEFFYCNTSSLFNRTYMANSTDMANSTETNSTRTITIHCRIKQIINMWQEVGRAMY
APPIAGNITCISNITGLLLTRDGGKNNTETFRPGGGNMKDNWRSELYKYKVVEVKPLGVA
PTNARRRVVEREKRAVGMGAVFLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWNSLWNWFNITN
WLWYIKIFIMIVGGLIGLRIIFAVLSLVNRVRQGYSPLSLQTLIPSPRGPDPPGGIEEEG
GEQDRNRSTRLVSGFLALVWDDLRSLCLFTYRRLRDFILIAARAGELLGRSSLKGLRRGW
EALKYLGSLVQYWGLELKRSAISLLDTLAIAVGEGTDRILEFVLGICRAIRNIPTRIRQG
FETALL
>TF.M11
MRVMGIQRNYPQWWIWSMLGFWMLMICNGMWVTVYYGVPVWKEAKTTLFCASDAKAYEKE
VHNVWATHACVPTDPNPQEMVLKNVTENFNMWKNDMVDQMHEDVISLWDQSLKPCVKLTP
LCVTLNCTNATASNSSIIEGMKNCSFNITTELRDKREKKNALFYKLDIVQLDGNSSQYRL
INCNTSVITQACPKVSFDPIPIHYCAPAGYAILKCNNKTFTGTGPCNNVSTVQCTHGIKP
VVSTQLLLNGSLAEGEIIIRSENITDNGKTIIVHLNESVKIECTRPNNKTRTSIRIGPGQ
AFYATGQVIGDIREAYCNINESKWNETLQRVSKKLKEYFPHKNITFQPSSGGDLEITTHS
FNCGGEFFYCNTSSLFNRTYMANSTDMANSTETNSTRTITIHCRIKQIINMWQEVGRAMY
APPIAGNITCISNITGLLLTRDGGKNNTETFRPGGGNMKDNWRSELYKYKVVEVKPLGVA
PTNARRRVVEREKPAVGMGAVFLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWNSLWNWFNITN
WLWYIKIFIMIVGGLIGLRIIFAVLSLVNRVRQGYSPLSLQTLIPSPRGPDRPGGIEEEG
GEQDRNRSTRLVSGFLALVWDDLRSLCLFTYHRLRDFILIAARAGELLGRSSLKGLRRGW
EALKYLGSLVQYWGLELKRSAISLLDTLAIAVGEGTDRILEFVLGICRAIRNIPTRIRQG
FETALL
>w20.14
MRVMGIQRNYPQWWIWSMLGFWMLMICNGMWVTVYYGVPVWKEAKTTLFCASDAKAYEKE
VHNVWATHACVPTDPNPQEMVLKNVTENFNMWKNDMVDQMHEDVISLWDQSLKPCVKLTP
LCVTLNCTNATASNNSIIEGMKNCSFNITTELRDKREKKNALFYKLDIVQLDGNSSQYRL
INCNTSVITQACPKVSFDPIPIHYCAPAGYAILKCNNKTFTGTGPCNNVSTVQCTHGIKP
VVSTQLLLNGSLAEGEIIIRSENITNNAKTIIVHLNESVKIECTRPNNKTRTSIRIGPGQ
AFYATGQVIGDIRKAYCNISESKWNETLQRVSKKLKEYFPHKNITFQPSSGGDLEITTHS
FNCGGEFFYCNTSSLFNRTYMANSTDMANSTETNSTRTITLHCRIKQIINMWQEVGRAMY
APPIAGNITCISNITGLLLTRDGGKNNTETFRPGGGNMKDNWRSELYKYKVVEVKPLGVA
PTNARRRVVEREKRAVGMGAVFLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNK
TYGDIWDNMTWMQWEREISNYTEIIYELLEESQNQQEKNEQDLLALDRWNSLWNWFNITN
WLWYIKIFIMIVGGLIGLRIIFAVLSLVNRVRQGYSPLSLQTLIPSPRGPDRPGGIEEEG
GEQDRNRSTRLVSGFLALVWDDLRSLCLFIYHRLRDFILIAARAGELLGRSSLKGLRRGW
EALKYLGSLVQYWGLELKRSAISLLDTLAIAVGEGTDRILEFVLGICRAIRNIPTRIRQG
FETALL
>w30.26
MRVMGIQRNYPQWWIWSMLGFWMLMICNGMWVTVYYGVPVWKEAKTTLFCASDAKAYEKE
VHNVWATHACVPTDPNPQEMVLKNVTENFNMWKNDMQMREDVISLWDQSLKPCVKMTP
LCVTLNCTNATAINSSIIEGMKNCSFNITTELRDKREKKNALFYKLDIVQLDGNSSQYRL
INCNTSVITQACPKVSFDPIPIHYCAPAGYAILKCNNKTFTGTGPCNNVSTVQCTHGIKP
VVSTQLLLNGSLAEGEIIIRSENITNNDKTIIVHLNESVKIECTRPNNKTRTSIRIGPGQ
AFYATGQVIGDIREAHCNISESKWNETLQRVSKKLKEYFPHKNITFQPSSGGDLEITTHS
FNCGGEFFYCNTSSLFNRTYMANSTDMANSTETNSTRTITIRCRIKQIINMWQEVGRAMY
APPIAGNITCISNITGLLLTRDGGKNNTETFRPGGGNMKDNWRSELYKYKVVEVKPLGVA
PTNAPPRVVEREKRAVGMGAVFLGFLGAAGSTMGAASITLTVQARQLLSGIVQQQSNLLK
```

FIG. 19B cont'd

ATEAQQHMLKLTVWGIKQLQARVLALERYLKDQQLLGMWGCSGKLICTTNVYWNSSWSNK
SYGDIWDNMTWMQWEREISNYTEIIYELLEESQNQQEKNEQDLLALDRWNSLWNWFNITN
WLWYIKIFIMIVGGLIGLRIIFAVLSIVNRVRQGYSPLSLQTLIPSPRGPDRPGGIEEEG
GEQDPNRSTRLVSGFLALVWDDLRSLCLFIYHRLRDFILIAARAGELLGRSSLKGLRRGW
EALKYLGSLVQYWGLELKRSAISLLDTLAIAVGEGTDRILEFVLGICRAIPNIPTRIRQG
FETALL
>w53.16
MRVMGIQRNYPQWWIWSMLGFWMLMICNGMWVTVYYGVPVWKEAKTTLFCASDAKAYEKE
VHNVWATHACVPTDPNPQEMVLKNVTENFNMWKNDMVQMHEDVISLWDQSLKPCVKLTP
LCVTLNCTNANATASNSSIIEGMNSSIIEGMKNCSFNITTELRDKREKKNALFYKLDIVQ
LDGNSSQYRLINCNTSVITQACPKVSFDPIPIHYCAPAGYAILKCNNKTFNGTGPCNNVS
TVQCTHGIKPVVSTQLLLNGSLAEGEIIIRSENITDNGKTIIVHLNESVKIECTRPSNNT
RTSIRIGPGQAFYATGQVIGDIREAHCNISESKWNETLQRVSEKLKEYFPHKNITFQPSS
GGDLEITTHSFNCGGEFFYCNTSSLFNRTYMATSTDMANSTETNSTRIITIRCRIKQIIN
MWQEVGRAMYAPPIAGNITCISNITGLLLTRDGGKNNTETFETFRPGGGNMKDNWRSELY
KYKVVEVKPLGVAPTNAPRRVVEREKRAVGMGAVFLGFLGAAGSTMGAASITLTVQARQL
LSGIVQQQSNLLKAIEAQQHMLKLTVWGIKQLQARVLALERYLKDQQLLGMWGCSGKLIC
TTNVYWNSSWSNKTYGDIWDNMTWMQWEREISNYTEIIYELLEESQNQQEKNEQDLLALD
RWNSLWNWFNITNWLWYIKIFIMIVGGLIGLRIIFAVLSIVNRVRQGYSPLSLQTLIPSP
RGPDRPGGIEEEGGEQDRNRSTRLVSGFLALAWDDLRSLCLFIYHRLRDFILIAARAGEL
LGRSSLKGLRRGWEALKYLGSLVQYWGLELKRSAISLLDTLAIAVGEGTDRILEFVLGIC
RAIRNIPTRIRQGFETALL
>w53.31
MRVMGIQRNYPQWWIWSMLGFWMLMICNGMWVTVYYGVPVWKEAKTTLFCASDAKAYEKE
VHNVWATHACVPTDPNPQEMVLKNVTENFNMWKNDMVQMHEDVISLWDQSLKPCVKLTP
LCVTLNCTDATASNATASNATASNSSIIEGMKNCSFNITTELRDKREKKNALFYKLDIVQ
LDGNSSQYRLINCNTSVITQACPKVSFDPIPIHYCAPAGYAILKCNNKTFNGTGPCNNVS
TVQCTHGIKPVVSTQLLLNGSLAEGEIIIRSENITDNGKTIIVHLNESVKIECTRPSNNT
PTSIRIGPGQAFYATGQVIGDIREAHCNISESKWNETLQRVSKKLKEYFPHKNITFQPSS
GGDLEITTHSFNCGGEFFYCNTSSLFNRTYMANSTETNSTRIITIRCRIKQIINMWQEVG
RAMYAPPIAGNITCISNITGLLLTRDGGNNNTETFRPGGGNMKDNWRSELYKYKVVEVKP
LGVAPTNARRRVVEREKRAVGMGAVFLGFLGAAGSTMGAASITLTVQARQLLSGIVQQQS
NLLKAIGAQQHMLKLTVWGIKQLQARVLALERYLKDQQLLGMWGCSGKLICTTNVYWNSS
WSNKTYGDIWDNMTWMQWEREISNYTEMIYELLEESQNQQEKNEQDLLALDPWNSLWNWF
NITNWLWYIKIFIMIVGGLIGLPIIFAVLSLVNRVRQGYSPLSLQTLIPSPRGPDRPGGI
EEEGGEQDRKPSTRLVSGFLALVWDDLRSLCLFIYHRLRDFILIAAPAGELLGRSSLKGL
RRGWEALKYLGSLVQYWGLELKRSAISLLDTLAIAVGEGTDRILEFALGICRAIPNIPTR
IRQGFETALL
>w78.7
MRVMGIQRNYQWWINSMLGFWMLMICNGMWVTVYYGVPVWKEAKTTLFCASDAKAYEKE
VHNVWATHACVPTDPNPQEMVLKNVTENFNMWKNDMVQMHEDVISLWDQSLKPCVKLTP
LCVTLNCTNVNATASNSSIIEGMNSSILEGMKNCSFNITTELRDKREKKNALFYKLDIVQ
LGGNSSQYRLINCNTSVITQACPKVSFDPIPIHYCAPAGYAILKCNNKTFNGTGPCNNVS
TVQCTHGIKPVVSTQLLLNGSLAEGEIIIRSKNITDNGKTIIVHLNESVKIECTRPSNNT
RTSIRIGPGQAFYATGQVIGDIREAHCNTSESKWNETLQRVSEKLKEYFPDKNITFQPSS
GGDLEITTHSFNCGGEFFYCNTSSLFNRTYMANSTDMANSTETNSTRIITIRCRIKQIIN
MWQEVGRAMYAPPIAGNITCISNITGLLLTRDGGENNTETFETFRPGGGNMKDNWRSELY
KYKVVEVKPLGVAPTNARRRVVEREKRAVGMGAVFLGFLGAAGSTMGAASITLTVQARQL
LSGIVQQQSNLLKAIEAQQHMLKLTVWGIKQLQARVLALERYLKDQQLLGMWGCSGKLIC
TTNVYWNSSWSNKTYGDIWDNMTWMQWEREISNYTELIYELLEESQNQQEKNEQDLLALD
RWNSLWDWFNITNWLWYTKIFIMIVGGLIGLRIIFAVLSLVNRVRQGYSPLSLQTLIPSP
RGPDRPGGIEEEGGEQDRNRSTRLVSGFLALAWDDLPSLCLFIYHRLRDFILIAARAGEL
LGRSSLKGLRPGWEALKYLGSLVQYWGLELKRSAISLLDTLAIAVGEGTDRILEFVLGIC
RAIRNIPTRIRQGFETALL
>w78.15
MRVMGIQRNYPQWWIWSMLGFWMLMICNGMWVTVYYGVPVWKEAKTTLFCASDAKAYEKE
VHNVWATHACVPTDPNPQEMVLKNVTENFNMWKNDMVQMHEDVISLWDQSLKPCVKLTP
LCVTLSCTNATNATASNSSILEGMKNCSFNITTELRDKREKKNALFYKLDIVQLDGNSSQ
YRLINCNTSVITQACPKVSFDPIPIHYCAPAGYAILKCNNKTFNGTGPCNNVSTVQCTHG
IKPVVSTQLLLNGSLAEGEIIIRSKNITDNGKTIIVHLNESVKIECTRPSNNTPTSIRIG
PGQAFYATGQVIGDIREAHCNISESKWNETLQRVSEKLKEYFPHKNITFQPSSGGDLEIT

FIG. 19B cont'd

THSFNCGGEFFYCNTSSLFNRTYMATSTDMANSFETNSTRIITIRCPIKQIINMWQEVGR
AMYAPPIAGNITCISNITGLLLTRDGGKNDTDTERFEGGNMKDNWRSELYKYVVEVKPL
GVAPTNARRRVVEREKRAVGMGAVFLGFLGAAGSTMGAASITLTVQARQLLSGIVQQQSN
LLKAIEAQQHMLKLTVWGIKQLQARVLALERYLKDQQLLGMWGCSGKLICTTNVYWNSSW
SNKTYGDIWDNMTWMQWEREISNYTELIYELLEESQNQQEKNEQDLLALDRWNSLWNWFN
ITNWLWYIKIFIMIVGGLIGLRIIFAVLSLVNRVRQGYSPLSLQTLIPSPRGPDRPGGIE
EEGGEQDRNRSTRLVSGFLALAWDDLRSLCLFIYHRLRDFILIAAPAGELLGRSSLKGLR
RGWEALKYLGNLVQYWGLELKPSAISLLDTLAIAVGEGTDRILEFVLGICRAIRNIPTRI
RQGFETALL
>w78.29
MRVMGRQRNYPQWWIWSMLGFWMLMICNGMWVTVYYGVPVWKEAKTTLFCASDAKAYEKE
VHNVWATHACVPTDPNPQEMVLKNVTENFNMWKNDMVDQMHEDVISLWDQSLTPCVKLTP
LCVTLNCTDATASNATASNATASNATASNSSIIEGMKNCSFNITTELRDKREKKNALFY
KLDIVQLDGNSSQYRLINCNTSVITQACPKVSFDPIPIHYCAPAGYAILKCNNKTFNGTG
PCNNVSTVQCTHGIKPVVSTQLLLNGSLAEGEIIIRSKNITDNGKTIIVHLNESVKIECT
RPSNNTRTSIRIGPGQAFYATGQVIGDIREAHCNISESKWNETLQRVSEKLKEYFPNKNI
TFQPSSGGDLEITTHSFNCGGEFFYCNTSSLFNRTYMANSTDMANSTETNSTRIITIRCR
IKQIINMWQEVGRAMYAPPIAGNITCISNPGLLLTRDGGKNNTETFETFRPGGGNMKDN
WRSELYKYKVVEVKPLGVAPTNARRRVVEREKPAVGNGAVFLGFLGAAGSTMGAASITLF
VQARQLLSGIVQQQSNLLKAIEAQQHMLKLTVWGIKQLQARVLALERYLKDQQLLGMWGC
SGKLICTTNVYWNSSWSNKTYGDIWDNMTWMQWEREISNYTEMIYELLEESQNQQEKNEQ
DLLALDRWNSLWNWFNITKWLWYIKIFIMIVGGLIGLRIIFAVLSLVNRVRQGYSPLSLQ
TLIPSPRGPDRPGGIEEEGGEQDRKPSTKLVSGFLALAWDDLRSLCLFIYHRLRDFILIA
ARAGELLGRSSLKGLRRGWEALKYLGSLVQYWGRELKRSAISLLDTLAIAVGEGTDRILE
FALRICRAIPNMPTRIRQGFETALL
>w78.33
MRVTCIQRNYPQWWIWSMLGLWMLMICNGMWVTVYYGVPVWKEAKTTLFCASDAKAYEKE
VHNVWATHACVPTDPNPQEMVLKNVTENFNMWKNDMADQMHEDVISLWDQSLKPCVKLTP
LCVTLNCIDANATASNATASNSSIIEGMKNCSFNITTELRDKIEKKNALFYKLDIVQLDG
NSSQYRLINCNTSVITQACPKVSFDPIPIHYCAPAGYAILKCNNKTFNGTSPCNNVSTVQ
CTHGIKPVVSTQLLLNGSLAEGEIIIRSENITNSAKTIIVHLNESVKIECTRPSNNTRTS
IRIGPGQAFYATGQVIGDIRKAHCNISESKWNETLQRVSKKLKEYFPHKNITFQPSSGGD
LEITTHSFNCGGEFFYCNPSSLFNRTYMANSTETNETRTITLECRIKQIINMWQEVGRAM
YAPPIAGNITCISNITGLLLTRDGGNNNTTETFRPGGGNMKDNWRSELYKYKVVEIKPLG
VAPTNARRRVVEPEKRAVGMGAVFLGPLGAAGSTMGAASITLTVQARQLLSGIVQQQSNL
LKAIEAQQHMLKLTVWGIKQLQARVLALERYLKDQQLLGMWGCSGKLICTTNVYWNSSWS
NKTYGDIWDNMTWMQWEREISDYTEIIYELLEESQNQQEKNEQDLLALDRWNSLWNWFNI
TNWLWYIKIFIMIVGGLIGLRIIFAVLSLVNRVRQGYSPLSLQTLTPSPRGPDRPGGIEE
EGGEQDRNKSTRLVSGFLALAWDDLRSLCLFIYHRLRDFILIAARAGELLGPSSLKGLRR
GWEALKYLGGLVQYWGLELKRSAISLLDTLAIAVGEGTDRILEFVLGICRAIRNIPTRIR
QGFETALL
>w100.A4
MRVMGIQRSYPQWWIWSMLGFWMLMICNGMWVTVYYGVPVWKEAKTTLFCASDAKAYEKE
VHNVWATHACVPTDPNPQEMVLKNVTENFNMWKNDMVDQMHEDVISLWDQSLKPCVKLTP
LCVTLNCINATNATASNSSILEGMKNCSFNITTELRDKREKKNALFYKLDIVQLDGNSSQ
YRLINCNTSVITQACPKVSFDPIPIHYCAPAGYAILKCNNKTFNGTGPCNNVSTVQCTHG
IKPVVSTQLLLNGSLAEGEIIIPSKNITDNGKTIIVHLNESVKIECTRPSNNTRTSIRIG
PGQAFYATGQVIGDIREAHCNISESKWNETLQFVSEKLKEYFPDKNITFQPSSGGDLEIT
THSFNCGGEFFYCNTSNLFNRTYMVNSTDMANSFETNSTRTITISCRIKQIINMWQEVGR
AMYAPPIAGNITCISNITGLLLTRDGGKNDTDTETFRPEGGNMKDNWRSELYKYKVVEVK
PLGVAPTNARRRVVEPEKRAVGMGAVFLGFLGAAGSTMGAASITLTVQARQLLSGIVQQQ
SNLLKAIEAQQHMLKLTVWGIKQLQARVLALERYLKDQQLLGMWGCSGKLICTTNVYWNS
SWSNKTYGDIWDNMTWMQWEREISNYTDIIYELLEESQNQQEKNEQDLLALDRWNSLWNW
FNITNWLWYIKIFIMIVGGLIGLRIIFAVLSLVNRVRQGYSPLSLQTLIPSPRGPDPPGG
IEEEGGEQDRNRSTRLVSGFLALAWDDLRSLCLFIYHRLRDFILIAARAGELLGRSSLKG
LRRGWEALKYLGSLVQYWGLELKRSAISLLDTLAIAVGEGTDRILEFVLGICRAIRNIPT
RIRQGFETALL
>w100.B4
MRVMGRQRNYPQWWIWSMLGLWMLMICNGMWVTVYYGVPVWKEAKTTLFCASDAKAYEKE
VHNVWATHACVPTDPNPQEMVLKNVTENFNMWENDMVDQMHEDVISLWDQSLKPCVKLTP
LCVTLNCTDANATASHTNATASNINATASKNSIIEKMKNCSFNITTELRDKREKKYALFY

FIG. 19B cont'd

```
KLDIVQLDGNSSQYRLINCNTSVITQACPKVSFDPIPIHYCAPAGYAILKCNNKTFNGTG
PCNNVSTVQCTHGIKPVVSTQLLLNGSLAEGEIIIRSKNITDNGKTIIVHLNESVKIECT
RPSNNTRTSIRTGPGQAFYATGQVIGDIREAHCNTSESKWNETLQRVSKKLKEYFPDKNI
TFQSSSGGDPEITTHSFNCGGEFFYCNTSSLFNRTYMANSTDMANSTETNSTRIITIRCR
IKQIINMWQEVGRAMYAPPIAGNITCISNITGLLLTRDGGNSSTETFRPEGGNMKDNWRS
ELYKYKVVEVKPLGVAPTNARRRVVEREKRAVGMGAVFLGFLGAAGSTMGAASITLTVQA
RQLLSGIVQQQSNLLKAIEAQQHMLKLTVWGIKQLQARVLALERYLKDQQLLGMWGCSGK
LICTTNVYWNSSWSNKTYDDIWDNMTWMQWEREISNYTEMIYDLLEESQNQQEKNEQDLL
ALDRWNSLWNWFNITKWLWYIKIFIMIVGGLIGLRIIFAVLSLVNRVRQGYSPLSLQTLI
PSPRGPDRPGGIEEEGGEQDRKRSTRLVSGFLALVWDDLRSLCLFIYHRLRDFILIAARA
GELLGRSSLKGLRRGWEALKYLGSLVQYWGLELKRSAISLLDTLAIAVGEGTDRILEFVL
GICRAIRNIPTRIRQGFETALL
>w100.B6
MKVRGIQRNYPQWWIWSMLGLWMLMICNGMWVTVYYGVPVWKEAKTTLFCASDAKAYEKE
VHNVWATHACVPTDPNPQEMVLENVTENFNMWKNDMADQMHEDVISLWDQSLKPCVKLTP
LCVTLNCTDANATASNTNATASNINATASKSSIIEEMKNCSFNITTELRDKREKKYALFY
KLDIVQLDGNSSQYRLINCNTSVITQACPKVSFDPIPIHYCAPAGYAILKCNNKTFNGTG
PCNNVSTVQCTHGIKPVVSTQLLLNGSLAEGEIIIRSENITDNSKTIIVHLNESVKIECT
RPSNNTRTSIRIGPGQAFYATGQVIGDIREAHCNISESKWNETLQRVSKKLKEYFPDKNI
TFQPSSGGDPEITTHSFNCGGEFFYCNTSSLFNRTYMANSTETNSTRTITLHCRIKQIIN
MWQEVGRAMYAPPIAGNITCISNITGLLLTRDGGENTRDGGNMNTETFRPEGGNMKDNWR
SELYKYKVVEVKPLGVAPTKARRRVVEREKRAVGMGAVFLGFLGAAGSTMGAASITLTVQ
ARQLLSGIVQQQSNLLKAIEAQQHMLKLTVWGIKQLQARVLALERYLKDQQLLGMWGCSG
KLICTTNVYWNSSWSNKTYGDIWDNMTWMQWEREISNYTDIIYDLLEESQNQQEKNEQDL
LALDRWNSLWNWFNITKWLWYIKIFIMIVGGLIGLRIIFAVLSLVNRVRQGYSPLSLQTL
IPSPRGPDRPGGIEEEGGEQDRNRSTRLVSGFLALAWDDLRSLCLFIYHRLRDFILIAAR
AGELLGRSSLKGLRRGWEALKYLGGLVQYWGLELKRSAISLLDTLAIAVGEGTDRILEFV
LGICRAIRNIPTRIRQGFETALL
```

FIG. 19C

CH505_D8gp120 constructs

>CH505TFA7gp120
MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNVKTIIVHLNESVKIECTRPNNKTRTSIRIGPGQAFYATGQVIGDIREAYCNINESKWNETL
QRVSKKLKEYFPHKNITPQPSSGGDLEITTHSFNCGGEFFYCNTSSLFNRTYMANSTDMANSTETNSTRTITIHCRIKQI
INMWQEVGRAMYAPPIAGNITCISNITGLLLTRDGGKNNTETFRPGGGNMKDNWRSELYKYKVVEVKPLGVAPTNARERV
VEREKE*

>CH505.w4.03_Δ8gp120
MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNVKTIIVHLNESVKIECTRPNNKTRTSIRIGPGQAFYATGQVIGDIREAYCNINESKWNETL
QRVSKKLKEYFPHKNITFQPSSGGDLEITTHSFNCGGEFFYCNTSSLFNRTYMANSTDMANSTETNSTRTITIHCRIKQI
INMWQEVGRAMYAPPIAGNITCISNITGLLLTRDGGKNNTETFRPGGGNMKDNWRSELYKYKVVEVKPLGVAPTNARERV
VEREKE

>CH505.w4.26_Δ8gp120
MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNVKTIIVHLNESVKIECTRPNNKTRTSIRIGPGQAFYATGQVIGDIREAYCNINESKWNETL
QRVSKKLKEYFPHKNITPQPSSGGDLEITTHSFNCGGEFFYCNTSSLFNRTYMANSTDMANSTETNSTRTITIHCRIKQI
INMWQEVGRAMYAPPIAGNITCISNITGLLLTRDGGKNNTETFRPGGGNMKDNWRSELYKYKVVEVKPLGVAPTNVRERV
VEREKE

>CH505.w20.14_Δ8gp120
MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNAKTIIVHLNESVKIECTRPNNKTRTSIRIGPGQAFYATGQVIGDIRKAYCNISESKWNETL
QRVSKKLKEYFPHKNITFQPSSGGDLEITTHSFNCGGEFFYCNTSSLFNRTYMANSTDMANSTETNSTRTITLHCRIKQI
INMWQEVGRAMYAPPIAGNITCISNITGLLLTRDGGKNNTETFRPGGGNMKDNWRSELYKYKVVEVKPLGVAPTNARERV
VEREKE

>CH505.w30.28_Δ8gp120
MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKDTPLCVTLNCTNATAINSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNVKTIIVHLNESVKIECTRPNNKTRTSIRIGPGQAFYATGQVIGDIREAHCNISESKWNETL
QEVSKKLKEYFPHKNITPQPSSGGDLEITTHSFNCGGEFFYCNTSSLFNRTYMANSTDMANSTETNSTRTITIRCRIKQI
INMWQEVGRAMYAPPIAGNITCISNITGLLLTRDGGKNNTETFRPGGGNMKDNWRSELYKYKVVEVKPLGVAPTNARERV
VEREKE

>CH505.w53.16_Δ8gp120
MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNANATASNSSIIEGMNSSIIEGMKNCSFNITTELRDKREK
KNALFYKLDIVQLDGNSSQYRLINCNTSVITQACPKVSFDPIPIHYCAPAGYAILKCNNKTFNGTGPCNNVSTVQCTHGI
KPVVSTQLLLNGSLAEGEIIRSENITDNGKTIIVHLNESVKIECTRPSNNTRTSIRIGPGQAFYATGQVIGDIREAHCN
ISESKWNETLQRVSEKLKEYFPHKNITFQPSSGGDLEITTHSFNCGGEFFYCNTSSLFNRTYMATSTDMANSTETNSTRI
ITIRCRIKQIINMWQEVGRAMYAPPIAGNITCISNITGLLLTRDGGKNNTETFETFRPGGGNMKDNWRSELYKYKVVEVK
PLGVAPTNARERVVEREKE

>CH505.w53.31_Δ8gp120
MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTDATASNATASNSSIIEGMKNCSFNITTELRDKREK
KNALFYKLDIVQLDGNSSQYRLINCNTSVITQACPKVSFDPIPIHYCAPAGYAILKCNNKTFNGTGPCNNVSTVQCTHGI
KPVVSTQLLLNGSLAEGEIIRSENITDNGKTIIRIGPGQAFYATGQVIGDIREAHCN
ISESKWNETLQRVSEKLKEYFPHKNITFQPSSGGDLEITTHSFNCGGEFFYCNTSSLFNRTYMANSTETNSTRIITTRCR
IKQIINMWQEVGRAMYAPPIAGNITCISNITGLLLTRDGGNNNTETFPGGGNMKDNWRSELYKYKVVEVKPLGVAPTNA
RERVVEREKE

>CH505.w78.7_Δ8gp120
MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNVNATASNSSIIEGMNSSILEGMKNCSFNITTELRDKREK
KNALFYKLDIVQLGGNSSQYRLINCNTSVITQACPKVSFDPIPIHYCAPAGYAILKCNNKTFNGTGPCNNVSTVQCTRGI
KPVVSTQLLLNGSLAEGEIIRSKNITDNGKTIIVHLNESVKIECTRPSNNTRTSIRIGPGQAFYATGQVIGDIREAHCN
ISESKWNETLQRVSEKLKEYFPDKNITFQPSSGGDLEITTHSFNCGGEFFYCNTSSLFNRTYMANSTDMANSTETNSTRI
ITIRCRIKQIINMWQEVGRAMYAPPIAGNITCISNITGLLLTRDGGENNTETFETFRPGGGNMKDNWRSELYKYKVVEVK
PLGVAPTNARERVVEREKE

>CH505.w78.15_Δ8gp120
MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLSCTNATNATASNSSILEGMKNCSFNITTELRDKREKKNALFYK
LDIVQLDGNSSQYRLINCNTSVITQACPKVSFDPIPIHYCAPAGYAILKCNNKTFNGTGPCNNVSTVQCTHGIKPVVSTQ
LLLNGSLAEGEIIRSKNITDNGKTIIVHLNESVKIECTRPSNNTRTSIRIGPGQAFYATGQVIGDIREAHCNISESKWN

FIG. 19C cont'd

ETLQRVSEKLKEYFPHKNITFQPSSGGDLEITTHSFNCGGEFFYCNTSSLFNRTYMATSTDMANSTETNSTRIITIRCRI
KQIINMWQEVGRAMYAPPIAGNITCISNITGLLLTRDGGKNDTDTFRPEGGNMKDNWRSELYKYKVVEVKPLGVAPTNAR
ERVVEREKE

>CH505.w78.25_A8gp120
MRVMGRQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLTPCVKLTPLCVTLNCTDATASNATASNATASNATASNSSIIEGMKNCSFNITTEL
RDKREKKNALFYKLDIVQLDGNSSQYRLINCNTSVITQACPKVSFDPIPIHYCAPAGYAILKCNNKTFNGTGPCNNVSTV
QCTHGIKPVVSTQLLLNGSLAEGEIIIRSKNITDNGKTIIVHLNESVKIECTRPSNNTRTSIRIGPGQAFYATGQVIGDI
REAHCNISESKWNETLQRVSEKLKEYFPNKNITFQPSSGGDLEITTHSFNCGGEFFYCNTSSLFNRTYMANSTDMANSTE
TNSTRIITIRCRIKQIINMWQEVGRAMYAPPIAGNITCISNITGLLLTRDGGKNNTETFETFRPGGNMKDNWRSELYKY
KVVEVKPLGVAPTNARERVVEREKE

>CH505.w78.env33.A8gp120
MRVTGIQRNYPQWWIWSMLGLWMLMICNGVPVWKEAKTTLFCASDAKAYEKEVHNVWATHACVPTDPNPQEMVLKNVTEN
FNMWKNDMADQMHEDVISLWDQSLKPCVKLTPLCVTLNCIDANATASNATASNSSIIEGMKNCSFNITTELRDKIERKNA
LFYKLDIVQLDGNSSQYRLINCNTSVITQACPKVSFDPIPIHYCAPAGYAILKCNNKTFNGTGPCNNVSTVQCTHGIKPV
VSTQLLLNGSLAEGEIIIRSENITNSAKTIIVHLNESVKIECTRPSNNTRTSIRIGPGQAFYATGQVIGDIRKAHCNISE
SKWNETLQRVSKKLKEYFPHKNITFQPSSGGDLEITTHSFNCGGEFFYCNTSSLFNRTYMANSTETNSTRTITLHCRIKQ
IINMWQEVGRAMYAPPIAGNITCISNITGLLLTRDGGNNNTETFRPGGNMKDNWRSELYKYKVVEIKPLGVAPTNARE
RVVEREKE >CH505.w100.A4_A8gp120
MRVMGIQRSYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVRLTPLCVTLNCINATNATASNSSILEGMKNCSFNITTELRDKREKKNALFYK
LDIVQLDGNSSQYRLINCNTSVITQACPKVSFDPIPIHYCAPAGYAILKCNNKTFNGTGPCNNVSTVQCTHGIKPVVSTQ
LLLNGSLAEGEIIIRSKNITDNGKTIIVHLNESVKIECTRPSNNTRTSIRIGPGQAFYATGQVIGDIREAHCNISESKWN
ETLQRVSEKLKEYFPDKNITFQPSSGGDLEITTHSFNCGGEFFYCNTSNLFNRTYMVNSTDMANSTETNSTRTITISCRI
KQIINMWQEVGRAMYAPPIAGNITCISNITGLLLTRDGGKNDTDTETFRPEGGNMKDNWRSELYKYKVVEVKPLGVAPTN
ARERVVEREKE >CH505.w100.B4_A8gp120
MRVMGRQRNYPQWWIWSMLGLWMLMICNGVPVWKEAKTTLFCASDAKAYEKEVHNVWATHACVPTDPNPQEMVLKNVTEN
FNMWENDMVDQMHEDVISLWDQSLKPCVKLTPLCVTLNCTDANATASNTNATASNINATASKNSIIEEMKNCSFNITTEL
RDKREKKYALFYKLDIVQLDGNSSQYRLINCNTSVITQACPKVSFDPIPIHYCAPAGYAILKCNNKTFNGTGPCNNVSTV
QCTHGIKPVVSTQLLLNGSLAEGEIIIRSKNITDNGKTIIVHLNESVKIECTRPSNNTRTSIRIGPGQAFYATGQVIGDI
REAHCNISESKWNETLQRVSKKLKEYFPDKNITFQSSSGGDPEITTHSFNCGGEFFYCNTSSLFNRTYMANSTDMANSTE
TNSTRIITIRCRIKQIINMWQEVGRAMYAPPIAGNITCISNITGLLLTRDGGNSTETFRPEGGNMKDNWRSELYKYKVV
EVKPLGVAPTNARERVVEREKE >CH505.w100.C7_A8gp120
MRVMGIQRNYPQWWIWSMLGLWMLMTCNGVPVWKEAKTTLFCASDAKAYEKEVHNVWATHACVPTDPNPQEMVLKNVTEN
FNMWENDMVDQMHEDVISLWDQSLKPCVKLTPLCVTLNCTDANATASNTNATASNINATASKSSIIEEMKNCSFNITTEL
RDKREKKYALFYKLDIVQLDGNSSQYRLINCNTSVITQACPKVSFDPIPIHYCAPAGYAILKCNNKTFNGTGPCNNVSTV
QCTHGIKPVVSTQLLLNGSLAEGEIIIRSKNITDNGKTIIVHLNESVKIECTRPSNNTRTSIRIGPGQAFYATGQVIGDI
REAHCNISESKWNETLQRVSKKLKEYFPDKNITFQSSSGGDPEITTHSFNCGGEFFYCNTSSLFNRTYMANSTDMANSTE
TNSTRIITIHCRIKQIINMWQEVGRAMYAPPIAGNITCISNITGLLLTRDGGENNGGKNNTETFRPGGGNMKDNWRSELY
KYKVVEVKPLGVAPTKARERVVEREKE >CH505.w100.B6_A8gp120
MKVRGIQRNYPQWWIWSMLGLWMLMICNGMWVTVYYGVPVWKEAKTFLFCASDAKAYEKE
VHNVWATHACVPTDPNPQEMVLENVTENFNMWKNDMADQMHEDVISLWDQSLKPCVKLTP
LCVTLNCTDANATASNTNATASNINATASNSKSSIIEEMKNCSFNITTELDKREKKYALFY
KLDIVQLDGNSSQYRLINCNTSVITQACPKVSFDPIPIHYCAPAGYAILKCNNKTFNGTG
PCNNVSTQTRGIKPVVSTQLLLNGSLAEGEIIIRSENITDNSKTIIVHLNESVKIECT
RPSNNTRTSIRIGPGQAFYATGQVIGDIREAHCNISESKWNETLQRVSKKLKEYFPDKNI
TFQPSSGGDPEITTHSFNCGGEFFYCNTSSLFNRTYMANSTETNSTRTITLHCRIKQIIN
MWQEVGRAMYAPPIAGNITCISNITGLLLTRDGGENTRDGGNNNTETFRPEGGNMKDNWR
SELYKYKVVEVKPLGVAPTKARERVVEREKE >CH0505.TF.M6.A8gp120_A8gp120
MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNAKTIIVHLNESVKIECTRPNNKTRTSIRIGPGQAFYATGQVIGDIREAYCNINESKWNETL
QRVSKKLKEYFPHKNITFQPSSGGDLEITTHSFNCGGEFFYCNTSSLFNRTYMANSTDMANSTETNSTRTITIHCRIKQI
INMWQEVGRAMYAPPIAGNITCISNITGLLLTRDGGKNNTETFRPGGGNMKDNWRSELYKYKVVEVKPLGVAPTNARERV
VEREKE*

>CH0505.TF.M10.A8gp120
MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNGKTIIVHLNESVKIECTRPNNKTRTSIRIGPGQAFYATGQVIGDIREAYCNINESKWNETL
QRVSKKLKEYFPHKNITFQPSSGGDLEITTHSFNCGGEFFYCNTSSLFNRTYMANSTDMANSTETNSTRTITIHCRIKQI
INMWQEVGRAMYAPPIAGNITCISNITGLLLTRDGGKNNTETFRPGGGNMKDNWRSELYKYKVVEVKPLGVAPTNARERV
VEREKE*

FIG. 19C cont'd

```
>CH0505.TF.M11.A8gp120
MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITDNGKTIIVHLNESVKIECTRPNNKTRTSIRIGPGQAFYATGQVIGDIREAYCNINESKWNETL
QRVSKKLKEYFPHKNITFQPSSGGDLEITTHSFNCGGEFFYCNTSSLFNRTYMANSTDMANSTETNSTRTITIHCRIKQI
INMWQEVGRAMYAPPIAGNITCISNITGLLLTRDGGKNNTETFRPGGGNMKDNWRSELYKYKVVEVKPLGVAPTNARERV
VEREKE*
```

FIG. 19D

Corresponding CH505_D8gp120 constructs cleavage site mutations:

```
>CH0505TFA7gp120mutC
MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNVKTIIVHLNESVKIECTRPNNKTRTSIRIGPGQTFYATGDVIGDIREAYCNINESKWNETL
QRVSKKLKEYFPHKNITFQPSSGGDLEITTHSFNCGGEFFYCNTSSLFNRTYMANSTDMANSTETNSTRTITIHCRIKQI
INMWQEVGRAMYAPPIAGNITCISNITGLLLTRDGGKNNTETFRPGGGNMKDNWRSELYKYKVVEVKPLGVAPTNARERV
VEREKE*
>CH505.w4.03_A8gp120mutC
MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNVKTIIVHLNESVKIECTRPNNKTRTSIRIGPGQTFYATGDVIGDIREAYCNINESKWNETL
QRVSKKLKEYFPHKNITFQPSSGGDLEITTHSFNCGGEFFYCNTSSLFNRTYMANSTDMANSTETNSTRTITIHCRIKQI
INMWQEVGRAMYAPPIAGNITCISNITGLLLTRDGGKNNTETFRPGGGNMKDNWRSELYKYKVVEVKPLGVAPTNARERV
VEREKE
>CH505.w4.26_A8gp120mutC
MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNVKTIIVHLNESVKIECTRPNNKTRTSIRIGPGQTFYATGDVIGDIREAYCNINESKWNETL
QRVSKKLKEYFPHKNITFQPSSGGDLEITTHSFNCGGEFFYCNTSSLFNRTYMANSTDMANSTETNSTRTITIHCRIKQI
INMWQEVGRAMYAPPIAGNITCISNITGLLLTRDGGKNNTETFRPGGGNMKDNWRSELYKYKVVEVKPLGVAPTNVRERV
VEREKE
>CH505.w20.14_A8gp120mutC
MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNVKTIIVHLNESVKIECTRPNNKTRTSIRIGPGQTFYATGDVIGDIREAYCNISESKWNETL
QRVSKKLKEYFPHKNITFQPSSGGDLEITTHSFNCGGEFFYCNTSSLFNRTYMANSTDMANSTETNSTRTITLHCRIKQI
INMWQEVGRAMYAPPIAGNITCISNITGLLLTRDGGKNNTETFRPGGGNMKDNWRSELYKYKVVEVKPLGVAPTNARERV
VEREKE
>CH505.w30.28_A8gp120mutC
MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKMTPLCVTLNCTNATAINSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNDKTIIVHLNESVKIECTRPNNKTRTSIRIGPGQTFYATGDVIGDIREAHCNISESKWNETL
QRVSKKLKEYFPHKNITFQPSSGGDLEITTHSFNCGGEFFYCNTSSLFNRTYMANSTDMANSTETNSTRTITIRCRIKQI
INMWQEVGRAMYAPPIAGNITCISNITGLLLTRDGGKNNTETFRPGGGNMKDNWRSELYKYKVVEVKPLGVAPTNARERV
VEREKE
>CH505.w53.16_A8gp120mutC
MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNANATASNSSIIEGMNSSIIEGMKNCSFNITTELRDKREK
KNALFYKLDIVQLDGNSSQYRLINCNTSVITQACPKVSFDPIPIHYCAPAGYAILKCNNKTFNGTGPCNNVSTVQCTHGI
KPVVSTQLLLNGSLAEGEIIIRSENITDNGKTIIVHLNESVKIECTRPNNKTRTSIRIGPGQTFYATGDVIGDIREAHCN
ISESKWNETLQRVSEKLKEYFPHKNITFQPSSGGDLEITTHSFNCGGEFFYCNTSSLFNRTYMATSTDMANSTETNSTRI
ITIRCRIKQIINMWQEVGRAMYAPPIAGNITCISNITGLLLTRDGGKNNTETFETPRPGGGNMKDNWRSELYKYKVVEVK
PLGVAPTNARERVVEREKE
```

FIG. 19D cont'd

```
>CH505.w53.31_ A8gp120mutC
MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTDATASNATASNATASNSSIIEGMKNCSFNITTELRDKREK
KNALFYKLDIVQLDGNSSQYRLINCNTSVITQACPKVSFDPIPIHYCAPAGYAILKCNNKTFNGTGPCNNVSTVQCTHGI
KPVVSTQLLLNGSLAEGEIIIRSENITDNGKTIIVHLNESVKIECTRPSNNTRTSIRIGPGQTFYATGDVIGDIREAHCN
ISESKWNETLQRVSKKLKEYFPHKNITFQPSSGGDLEITTHSFNCGGEFFYCNTSSLFNRTYMANSTETNSTRIITIRCR
IKQIINMWQEVGRAMYAPPIAGNITCISNITGLLLTRDGGNNNTETFRPGGGNMKDNWRSELYKYKVVEVKPLGVAPTNA
RERVVEREKE
>CH505.w78.7_ A8gp120mutC
MRVMGIQRNYTQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNVATASNSSIIEGMNSSILEGMKNCSFNITTELRDKREK
KNALFYKLDIVQLGGNSSQYRLINCNTSVITQACPKVSFDPIPIHYCAPAGYAILKCNNKTFNGTGPCNNVSTVQCTHGI
KPVVSTQLLLNGSLAEGEIIIRSKNITDNGKTIIVHLNESVKIECTRPSNNTRTSIRIGPGQTFYATGDVIGDIREAHCN
ISESKWNETLQRVSEKLKEYFPDKNITFQPSSGGDLEITTHSFNCGGEFFYCNTSSLFNRTYMANSTDMANSTETNSTRI
ITIRCRIKQIINMWQEVGRAMYAPPIAGNITCISNITGLLLTRDGGENNTETFETFRPGGGNMKDNWRSELYKYKVVEVK
PLGVAPTNARERVVEREKE
>CH505.w78.15_ A8gp120mutC
MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLSCTNATNATASNSSILEGMKNCSFNITTELRDKREKKNALFYK
LDIVQLDGNSSQYRLINCNTSVITQACPKVSFDPIPIHYCAPAGYAILKCNNKTFNGTGPCNNVSTVQCTHGIKPVVSTQ
LLLNGSLAEGEIIIRSKNITDNGKTIIVHLNESVKIECTRPSNNTRTSIRIGPGQTFYATGDVIGDIREAHCNISESKWN
ETLQRVSEKLKEYFPHKNITFQPSSGGDLEITTHSFNCGGEFFYCNTSSLFNRTYMATSTDMANSTETNSTRIITIRCRI
KQIINMWQEVGRAMYAPPIAGNITCISNITGLLLTRDGGKNDTDTFRPEGGNMKDNWRSELYKYKVVEVKPLGVAPTNAR
ERVVEREKE
>CH505.w78.25_ A8gp120mutC
MRVMGRQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLTPCVKLTPLCVTLNCTDATASNATASNATASNATASNSSIIEGMKNCSFNITTEL
RDKREKKNALFYKLDIVQLDGNSSQYRLINCNTSVITQACPKVSFDPIPIHYCAPAGYAILKCNNKTFNGTGPCNNVSTV
QCTHGIKPVVSTQLLLNGSLAEGEIIIRSKNITDNGKTIIVHLNESVKIECTRPSNNTRTSIRIGPGQTFYATGDVIGDI
REAHCNISESKWNETLQRVSEKLKEYFPNKNITFQPSSGGDLEITTHSFNCGGEFFYCNTSSLFNRTYMANSTDMANSTE
TNSTRIITIRCRIKQIINMWQEVGRAMYAPPIAGNITCISNITGLLLTRDGGKNNTETFETFRPGGGNMKDNWRSELYKY
KVVEVKPLGVAPTNARERVVEREKE
>CH505.w78.env33.A8gp120mutC
MRVTGIQRNYPQWWIWSMLGLWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCIDANATASNATASNSSIIEGMKNCSFNITTELRDKIEKKNA
LFYKLDIVQLDGNSSQYRLINCNTSVITQACPKVSFDPIPIHYCAPAGYAILKCNNKTFNGTGPCNNVSTVQCTHGIKPV
VSTQLLLNGSLAEGEIIIRSENITNSAKTIIVHLNESVKIECTRPSNNTRTSIRIGPGQTFYATGDVIGDIRKAHCNISE
SKWNETLQRVSKKLKEYFPHKNITFQPSSGGDLEITTHSFNCGGEFFYCNTSSLFNRTYMANSTETNSTRTITLHCRIKQ
IINMWQEVGRAMYAPPIAGNITCISNITGLLLTRDGGNNSTTETFRPGGGNMKDNWRSELYKYKVVEIKPLGVAPTNARE
RVVEREKE
>CH505.w100.A4_ A8gp120mutC
MRVMGIQRSYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVRLTPLCVTLNCINATNATASNSSILEGMKNCSFNITTELRDKREKKNALFYK
LDIVQLDGNSSQYRLINCNTSVITQACPKVSFDPIPIHYCAPAGYAILKCNNKTFNGTGPCNNVSTVQCTHGIKPVVSTQ
LLLNGSLAEGEIIIRSKNITDNGKTIIVHLNESVKIECTRPSNNTRTSIRIGPGQTFYATGDVIGDIREAHCNISESKWN
ETLQRVSEKLKEYFPDKNITFQPSSGGDLEITTHSFNCGGEFFYCNTSSLFNRTYMVNSTDMANSTETNSTRTITISCRI
KQIINMWQEVGRAMYAPPIAGNITCISNITGLLLTRDGGKNDTDTETFRPEGGNMKDNWRSELYKYKVVEVKPLGVAPTN
ARERVVEREKE
>CH505.w100.B4_ A8gp120mutC
MRVMGRQRNYPQWWIWSMLGLWMLMICNGVPVWKEAKTTLFCASDAKAYEKEVHNVWATHACVPTDPNPQEMVLKNVTEN
FNMWENDMVDQMHEDVISLWDQSLKPCVKLTPLCVTLNCTDANATASNTNATASNINATASKNSIIEEMKNCSFNITTEL
RDKREKKYALFYKLDIVQLDGNSSQYRLINCNTSVITQACPKVSFDPIPIHYCAPAGYAILKCNNKTFNGTGPCNNVSTV
QCTHGIKPVVSTQLLLNGSLAEGEIIIRSKNITDNGKTIIVHLNESVKIECTRPSNNTRTSIRIGPGQTFYATGDVIGDI
REAHCNISESKWNETLQRVSKKLKEYFPDKNITFQSSSGGDPEITTHSFNCGGEFFYCNTSSLFNRTYMANSTDMANSTE
TNSTRIITIRCRIKQIINMWQEVGRAMYAPPIAGNITCISNITGLLLTRDGGNSSTETFRPEGGNMKDNWRSELYKYKVV
EVKPLGVAPTNARERVVEREKE
>CH505.w100.C7_ A8gp120mutC
MRVMGIQRNYPQWWIWSMLGLWMLMTCNGVPVWKEAKTTLFCASDAKAYEKEVHNVWATHACVPTDPNPQEMVLKNVTEN
FNMWENDMVDQMHEDVISLWDQSLKPCVKLTPLCVTLNCTDANATASNTNATASNINATASKSSIIEEMKNCSFNITTEL
RDKREKKYALFYKLDIVQLDGNSSQYRLINCNTSVITQACPKVSFDPIPIHYCAPAGYAILKCNNKTFNGTGPCNNVSTV
QCTHGIKPVVSTQLLLNGSLAEGEIIIRSKNITDNGKTIIVHLNESVKIECTRPSNNTRTSIRIGPGQTFYATGDVIGDI
REAHCNISESKWNETLQRVSKKLKEYFPDKNITFQSSSGGDPEITTHSFNCGGEFFYCNTSSLFNRTYMANSTDMANSTE
TNSTRIITIHCRIKQIINMWQEVGRAMYAPPIAGNITCISNITGLLLTRDGGENNGGKNNTETFRPGGGNMKDNWRSELY
KYKVVEVKPLGVAPTKARERVVEREKE
```

FIG. 19D cont'd

>CH505.w100.B6_Δ8gp120mutC
MKVRGIQRNYPQWWIWSMLGLWMLMICNGMWVTVYYGVPVWKEAKTTLFCASDAKAYEKE
VHNVWATHACVPTDPNPQEMVLENVTENFNMWKNDMADQMHEDVISLWDQSLKPCVKLTP
LCVTLNCTDANATASNTNATASNINATASKSSIIEEMKNCSFNITTELRDKREKKYALFY
KLDIVQLDGNSSQYRLINCNTSVITQACPKVSFDPIPIHYCAPAGYAILKCNNKTFNGTG
PCNNVSTVQCTRGIKPVVSTQLLLNGSLAEGEIIIRSENITDNSKTIIVHLNESVKIECT
RPSNNTRTSIRIGPGQTFYATGDVIGDIREAHCNISESKWNETLQRVSKKLKEYFPDKNI
TFQPSSGGDPEITTHSFNCGGEFFYCNTSSLFNRTYMANSTETNSTRTITLHCRIKQIIN
MWQEVGRAMYAPPIAGNITCISNITGLLLTRDGGENTRDGGNNNTETFRPEGGNMKDNWR
SELYKYKVVEVKPLGVAPTKARERVVEREKE >CH0505.TF.M6.Δ8gp120_Δ8gp120mutC
MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNAKTIIVHLNESVKIECTRPNNKTRTSIRIGPGQTFYATGDVIGDIREAYCNINESKWNETL
QRVSKKLKEYFPHKNITFQPSSGGDLEITTHSFNCGGEFFYCNTSSLFNRTYMANSTDMANSTETNSTRTITIHCRIKQI
INMWQEVGRAMYAPPIAGNITCISNITGLLLTRDGGKNNTETFRPGGGNMKDNWRSELYKYKVVEVKPLGVAPTNARERV
VEREKE*

>CH0505.TF.M10.Δ8gp120mutC
MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITNNGKTIIVHLNESVKIECTRPNNKTRTSIRIGPGQTFYATGDVIGDIREAYCNINESKWNETL
QRVSKKLKEYFPHKNITFQPSSGGDLEITTHSFNCGGEFFYCNTSSLFNRTYMANSTDMANSTETNSTRTITIHCRIKQI
INMWQEVGRAMYAPPIAGNITCISNITGLLLTRDGGKNNTETFRPGGGNMKDNWRSELYKYKVVEVKPLGVAPTNARERV
VEREKE*

>CH0505.TF.M11.Δ8gp120mutC
MRVMGIQRNYPQWWIWSMLGFWMLMICNGVPVWKEAKTTLFCASDAKAYEKEVHNVWATHACVPTDPNPQEMVLKNVTEN
FNMWKNDMVDQMHEDVISLWDQSLKPCVKLTPLCVTLNCTNATASNSSIIEGMKNCSFNITTELRDKREKKNALFYKLDI
VQLDGNSSQYRLINCNTSVITQACPKVSFDPIPIHYCAPAGYAILKCNNKTFTGTGPCNNVSTVQCTHGIKPVVSTQLLL
NGSLAEGEIIIRSENITDNGKTIIVHLNESVKIECTRPNNKTRTSIRIGPGQTFYATGDVIGDIREAYCNINESKWNETL
QRVSKKLKEYFPHKNITFQPSSGGDLEITTHSFNCGGEFFYCNTSSLFNRTYMANSTDMANSTETNSTRTITIHCRIKQI
INMWQEVGRAMYAPPIAGNITCISNITGLLLTRDGGKNNTETFRPGGGNMKDNWRSELYKYKVVEVKPLGVAPTNARERV
VEREKE*

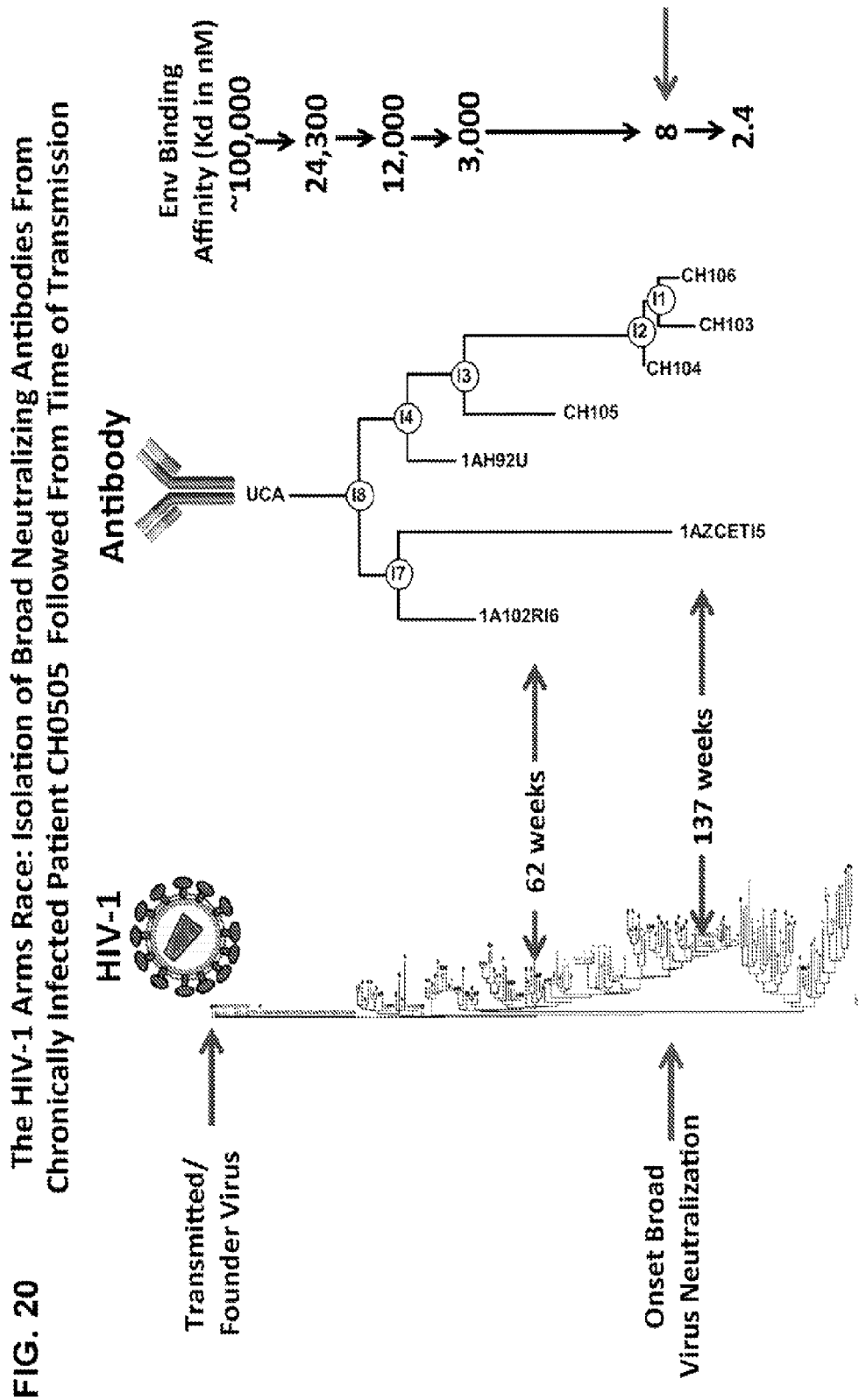
FIG. 20 The HIV-1 Arms Race: Isolation of Broad Neutralizing Antibodies From Chronically Infected Patient CH0505 Followed From Time of Transmission FIG. 23  The number of pairwise differences in just the CD4/b12/VRC01 contact residues is also relatively high for CH10505

FIG. 26

HIV-1 Vaccine Design

HIV-1 Env design to improve Env design to focus induction of CD4 biding site antibodies by deletion of V1, V2 and V3 loop sequences that were highlighted in red font (as example by CH0505_CON gp120) resulting in a core Env as example shown in example as CH0505_ΔV123core. This strategy can also be applied to the other HIV-1 Envs in CH505 Envs and well as the other HIV-1 Envs.

>CH0505_CON gp120
MRVMGIQRNYPQWWIWSMLGFWMLMICNGMWVTVYYGVPVWKEAKTTLFCASDAKAYEKEVHNVWATHACVPTDPNPQEMVLKNVTENF
NMWKNDMVDQMHEDVISLWDQSLKPCVKLTPLCVTLNCTNATASNSSIIEGMKNCSFNITTELRDKREKKNALFYKLDIVQLDGNSSQY
RLINCNTSVITQACPKVSFDPIPIHYCAPAGYAILKCNNKTFTGTGPCNNVSTVQCTHGIKPVVSTQLLLNGSLAEGEIIIRSENITNN
VKTIIVHLNESVKIECTRPNNKTRTSIRIGPGQAFYATGQVIGDIREAYCNINESKWNETLQRVSKKLKEYFPHKNITFQPSSGGDLEI
TTHSFNCGGEFFYCNTSSLFNRTYMANSTDMANSTETNSTRTITIHCRIKQIINMWQEVGRAMYAPPIAGNITCISNITGLLLTRDGGK
NNTETFRPGGGNMKDNWRSELYKYKVVEVKPLGVAPTNARERVVEREKE

>CH0505_ΔV123core
MRVMGIQRNYPQWWIWSMLGFWMLMICNGMWVTVYYGVPVWKEAKTTLFCASDAKAYEKEVHNVWATHACVPTDPNPQEMVLKNVTENF
NMWKNDMVDQMHEDVISLWDQSLKPCVKCPKVSFDPIPIHYCAPAGYAILKCNNKTFTGTGPCNNVSTVQCTHGIKPVVSTQLLLNGSL
AEGEIIIRSENITNNVKTIIVHLNESVKIECTREAYCNINESKWNETLQRVSKKLKEYFPHKNITFQPSSGGDLEITTHSFNCGGEFFY
CNTSSLFNRTYMANSTDMANSTETNSTRTITIHCRIKQIINMWQEVGRAMYAPPIAGNITCISNITGLLLTRDGGKNNTETFRPGGGNM
KDNWRSELYKYKVVEVKPLGVAPTNARERVVEREKE

FIG. 27

The Goal of This Study Is:

Determine viral evolution during bnAb development in the HIV-1 infected individual (CH505)

Clonal Lineage Tree of Clone CH103 from CH0505 Time After Transmission of Mab Isolation and 454 Analysis (VH4-61, Vλ3-1)

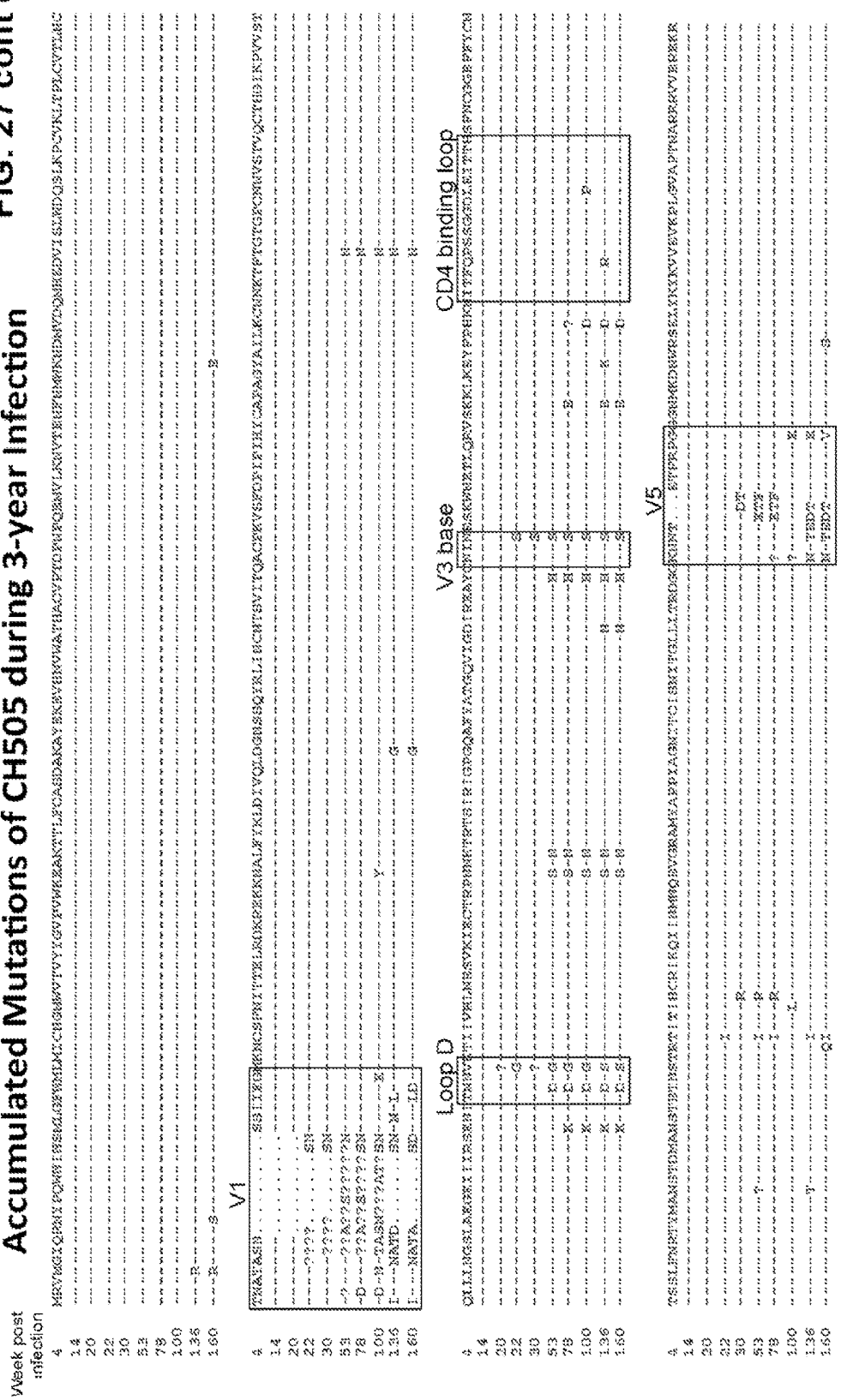

FIG. 27 cont'd

Steps of A B Cell Lineage Based Approach to Vaccine Design

Haynes, B, Harrison, S, Kelsoe, G and Kepler T, Nature Biotech. 30: 423, 2012

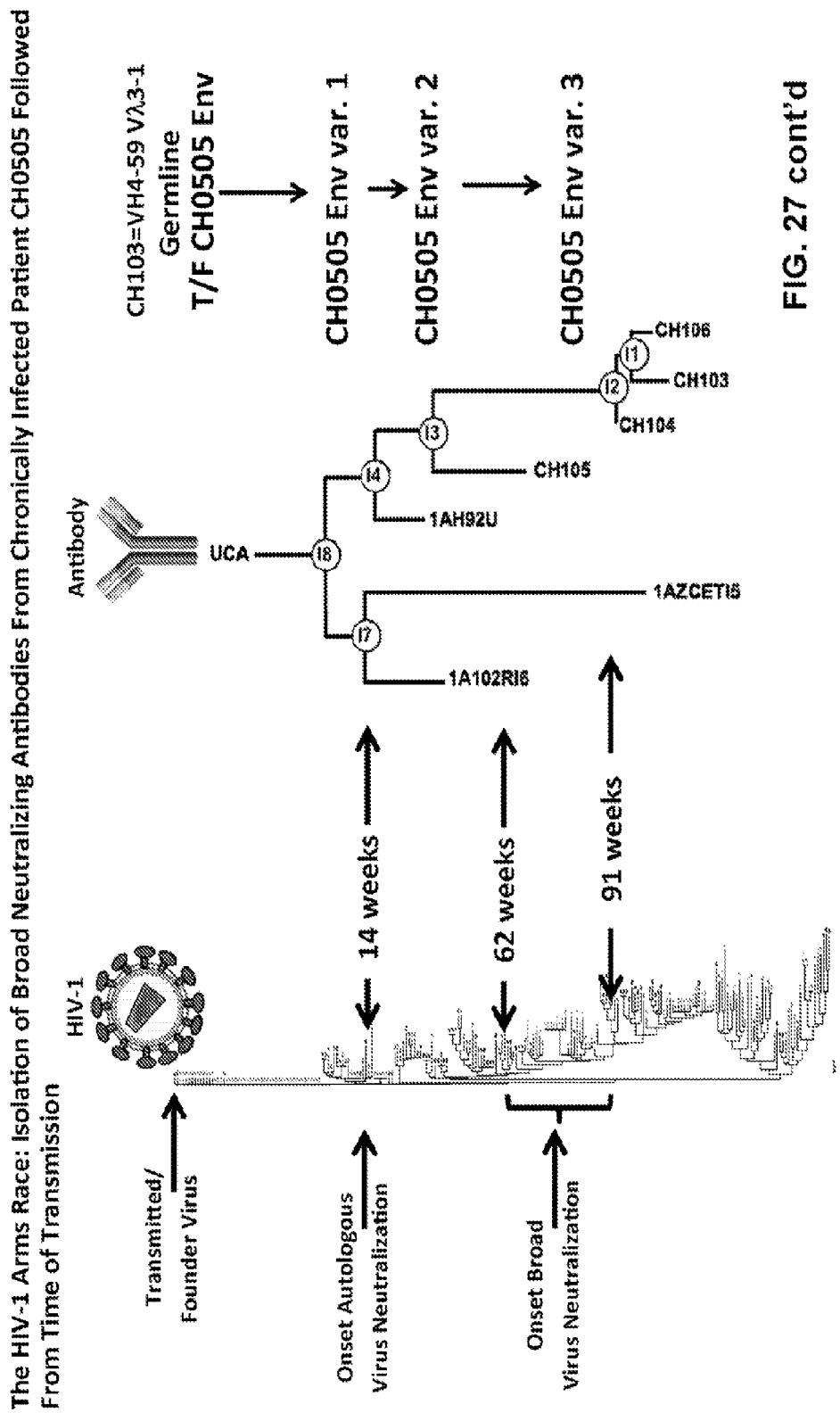

Clinical Trials

Trial 1. B. 63521 IM X4, 2 months apart

Trial 2. C.CH0505 IM X4, 2 months apart

Trial 3. B.9021 IM X4, 2 months apart

Trial 4. AE.427299 IM X4, 2 months apart

Trial 5. C.CH0505, B.63521, B.9021, AE.427299 IM, 2 months apart either all together or in sequence Adjuvant: MF-59, AS01B, IDRI (GLA)

Alignment of CH505 Env gp120 with RSC3

```
CH505gp120  192  CPKVSFDPIPIHYCAPAGYAILKCNNKTFTGTGPCNNVSTVQCTHGIKPVVSTQLLLNGS  251
                 CP V F  P+PI YCAP GYAILKCNN+ F GTGPC NVS V CT GI PVVS+QLLLNG+
RSC3         64  CPTVREKPVPTRYCAPPGYAILKCNNKTFNGTGPCTNVSVTCTDGIHPVVSSQLLLNGT  123

CH505gp120  252  LAEGEIIIRSNLTNNVKTIIVHLNESVKIECTRPNNNKTRTSIRIGPGQAFYATGQVIGD  311
                 LA+   +++IRS N  ++N KTI+V LN SV+I CT
RSC3        124  LADEKVVIRSNFSDNAKTIIVQLNTSVEINCT-----------------------------  156

CH505gp120  312  IREAYCNINESKWNETLQRVSKKLKEYFP-HKNITFQPSSGGDLEITTHSFNCGGEFFYC  370
                 +  +CNI  +KWN+TL++++++KL +E F  +K I F+PSSGGD EI TH FNCGG+FFYC
RSC3        157  -GGGHCNITRAKWNQTLKQIAEKLREQFGNNKTLIFKPSSGGDPEIVTHMFNCGGKFFYC  215

CH505gp120  371  NTSSLFNRTYMANSTDMANSTETNSTRTITIHCRIKQIINMWQEVGRAMYAPPIAGNITC  430
                 N++  LFN +  ++    S   T  + TIT+  CRI+  I  M     VG+  +YAPP+ G  TC
RSC3        216  NSTQLFNSTWENSTWSTKGSNNTEGSDTITLPCRIRSITGMVCTVGKMIYAPPVEGVITC  275

CH505gp120  431  ISNITGLLLTRDGGKNNTET--FRPGGGNMKDNWRSELYKYKVVEV                474
                 SNITGLLLTRDGG      +N E+  FRPGGG+M+DNWRSELYKY +V +
RSC3        276  SSNITGLLLLTRDGGNDNNESEIFRPGGGDMRDNWRSELYKYRVVRL               321
```

Design for CH505 out domain immunogen

>CH505TF_ODwV3
MRVMGIQRNYPQWWIWSMLGFWMLMICNGSTQLLLNGSLAEGEIIIRSENITNNVKTIIVHLNESVKI
ECTRPNNKTRTSIRIGPGQAFYATGQVIGDIREAYCNINESKWNETLQRVSKKLKEYFPHKNITFQPS
SGGDLEITTHSFNCGGEFFYCNTSSLFNRTYMANSTDMANSTETNSTRTITIHCRIKQIINMWQEVGR
AMYAPPIAGNITCISNITGLLLTRDGGKNNTETFRPGGGNMKDNWRSELYKYKVV*

Sequence in black is the signal peptide of CH505 Env, sequence highlighted in blue is most part of the V3 loop and sequence highlighted in red is the outer domain.

Prediction of cleavage after translation:

Prediction indicated that construct with simple connection of CH505 signal peptide sequence with the outer domain would not been cleaved efficiently.

FIG. 29

By insertion of Q between signal peptide and out domain of CH505
Env, it would improve the cleavage significantly.

>CH505TF_qODwV3 (with V3 loop sequence)
MRVMGIQRNYPQWWIWSMLGFWMLMICNGQSTQLLLNGSLAEGEIIIRSENITNNVKTIIVHLNESVK
IECTRPNNKTRTSIRIGPGQAFYATGQVIGDIREAYCNINESKWNETLQRVSKKLKEYFPHKNITFQP
SSGGDLEITTHSFNCGGEFFYCNTSSLFNRTYMANSTDMANSTETNSTRTITIHCRIKQIINMWQEVG
RAMYAPPIAGNITCISNITGLLLTRDGGKNNTETFRPGGGNMKDNWRSELYKYKVV*

>CH505TF_qOD (without most part of V3 loop)
MRVMGIQRNYPQWWIWSMLGFWMLMICNGQSTQLLLNGSLAEGEIIIRSENITNNVKTIIVHLNESVK
IECTREAYCNINESKWNETLQRVSKKLKEYFPHKNITFQPSSGGDLEITTHSFNCGGEFFYCNTSSLF
NRTYMANSTDMANSTETNSTRTITIHCRIKQIINMWQEVGRAMYAPPIAGNITCISNITGLLLTRDGG
KNNTETFRPGGGNMKDNWRSELYKYKVV*

FIG. 29 cont'd

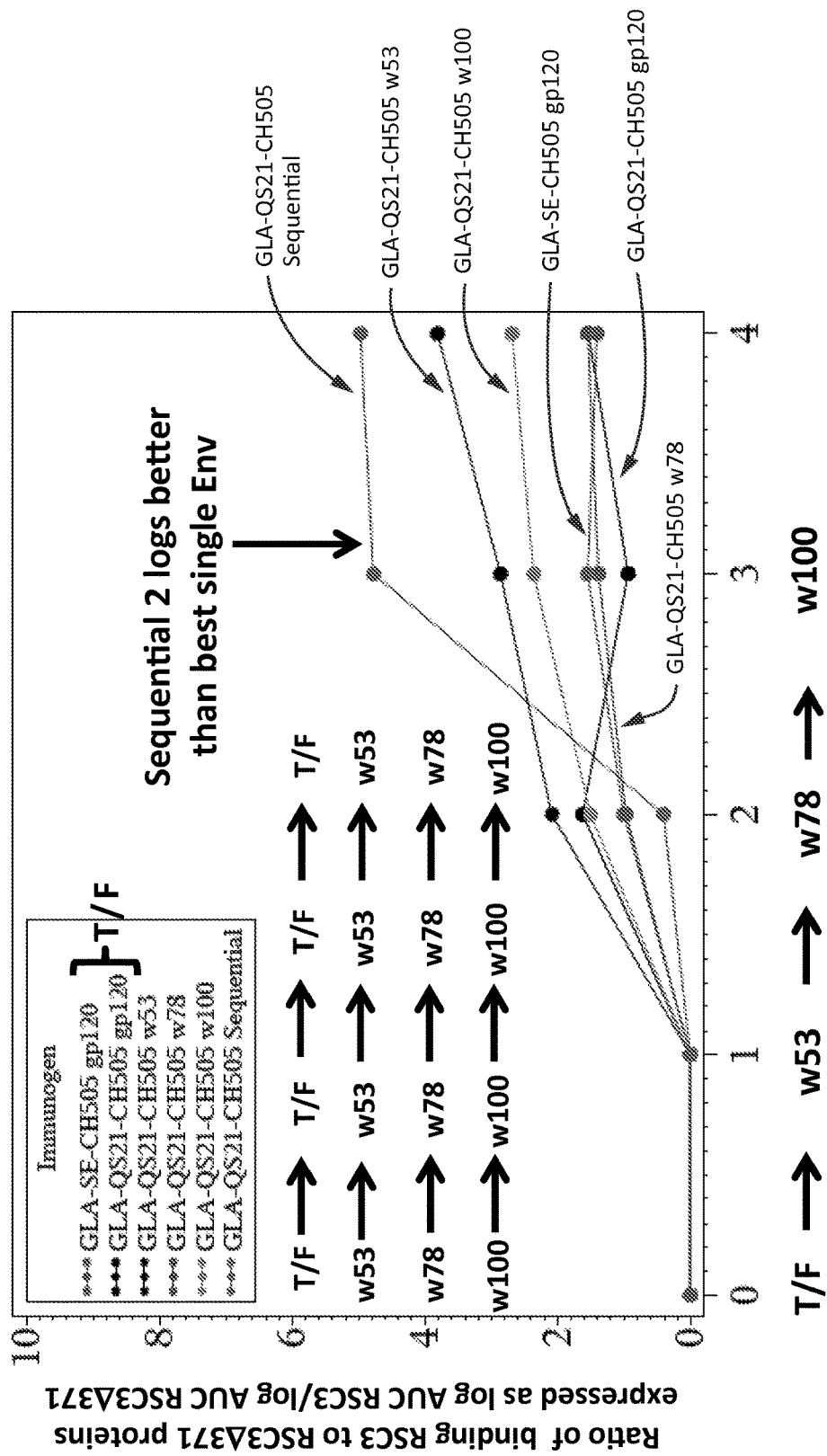

FIG. 31

Table 1.

| Sample ID | Week after Infection | EC50, reciprocal dilution | | | | | | |
|---|---|---|---|---|---|---|---|---|
| | | MuLV | CH505 | B.SF162 | B.JRFL | A.Q168 | A.842 | B.BG1168 |
| G770DM2V-12 | 6 | <20 | <20 | <20 | <20 | <20 | <20 | <20 |
| G770DPFL-12 | 7 | <20 | <20 | <20 | <20 | <20 | <20 | <20 |
| K770DQNT-15 | 8 | <20 | <20 | <20 | <20 | <20 | <20 | <20 |
| K770F1ZZ-12_16 | 14 | <20 | 45 | <20 | <20 | <20 | <20 | <20 |
| A770FDB0-13 | 20 | <20 | 157 | 29 | <20 | <20 | <20 | <20 |
| C770FJKX-13 | 22 | <20 | 267 | 28 | <20 | <20 | <20 | <20 |
| F770G05F-11 | 30 | <20 | 1,291 | 60 | <20 | <20 | 53 | <20 |
| A770GN15-12 | 41 | <20 | 1,636 | 154 | 56 | <21 | 183 | <20 |
| A770H7QF-11 | 53 | <20 | 1,701 | 237 | 244 | 32 | 367 | <20 |
| D8Z03WQG-03 | 66 | <20 | 3,193 | 401 | 701 | 69 | 345 | <20 |
| K8Z047D8-04 | 78 | <20 | 6,428 | 1,172 | 806 | 83 | 293 | 25 |
| A770IL0J-12 | 92 | <20 | 3,396 | 1,534 | 522 | 92 | 473 | 35 |
| J770JXKQ-12 | 100 | <20 | 2,464 | 1,066 | 619 | 94 | 433 | 56 |
| K770KQ98-12 | 136 | <20 | 4,985 | 4,651 | 2,085 | 172 | 326 | 51 |
| A770KRJ3-13 | 138 | <20 | 3,586 | 5,081 | 1,368 | 138 | 237 | 56 |
| H770KSHS-12 | 140 | <20 | 3,374 | 13,407 | 1,287 | 148 | 237 | 40 |
| C770KW30-13 | 144 | <20 | 4,665 | 8,354 | 905 | 118 | | |

FIG. 31 (cont.)

Table 1. (cont.)

| | | | | | | |
|---|---|---|---|---|---|---|
| F77OL0XJ-12 | 152 | <20 | 1,789 | 3,122 | 1,612 | 108 | 234 | 35 |
| K8Z06JCY-03 | 160 | <20 | 2,684 | 9,761 | 2,482 | 144 | 230 | 55 |
| K77OLJF6-12 | 176 | <20 | 2,003 | 5,148 | 2,243 | 91 | 150 | 58 |
| B77OMDVN-11 | 208 | <20 | 1,353 | 5,850 | 1,303 | 60 | 95 | 31 |
| E77ONW1S-11 | 233 | <20 | 3,279 | 3,612 | 895 | 107 | 151 | 37 |
| K8Z07X34-04 | 234 | <20 | 3,033 | 4,887 | 1,712 | 103 | 232 | 60 |
| D8Z07Y9M-06 | 236 | <20 | 1,969 | 4,417 | 1,354 | 107 | 299 | 57 |
| 2F5* | >50 | >50 | 0.69 | 2.26 | 1.62 | 11.71 | 1.43 |

FIG. 32

Table 2.

| Antibody ID | IgH_ID | VH | DH | JH | Mutation frequency | CDR H3 length | Isotype | VL ID | VL | JL | Mutation frequency | CDRL3 length |
|---|---|---|---|---|---|---|---|---|---|---|---|---|
| UCA | UCAVH | 4-59*01 | 3-16*01 | 4*02 | 0.0% | 15 | IgG1 | UCAVL | 3-1*01 | 1*01 | 0% | 10 |
| I8 | I8VH | 4-59*01 | 3-16*01 | 4*02 | 3.6% | 15 | IgG1 | UCAVL | 3-1*01 | 1*01 | 0% | 10 |
| I7 | I7VH | 4-59*01 | 3-16*01 | 4*02 | 5.0% | 15 | IgG1 | UCAVL | 3-1*01 | 1*01 | 0% | 10 |
| I4 | I4VH | 4-59*01 | 3-16*01 | 4*02 | 6.9% | 15 | IgG1 | UCAVL | 3-1*01 | 1*01 | 0% | 10 |
| I3 | I3VH | 4-59*01 | 3-16*01 | 4*02 | 9.1% | 15 | IgG1 | I2VL | 3-1*01 | 1*01 | 10.0% | 10 |
| I2 | I2VH | 4-59*01 | 3-16*01 | 4*02 | 14.9% | 15 | IgG1 | I2VL | 3-1*01 | 1*01 | 10.0% | 10 |
| I1 | I1VH | 4-59*01 | 3-16*01 | 4*02 | 15.2% | 15 | IgG1 | I2VL | 3-1*01 | 1*01 | 10.0% | 10 |
| 1AZCETI5 | 1AZCETI5VH | 4-59*01 | 3-16*01 | 4*02 | 15.2% | 15 | IgG1 | I2VL | 3-1*01 | 1*01 | 10.0% | 10 |
| 1AH92U | 1AH92UVH | 4-59*01 | 3-16*01 | 4*02 | 8.3% | 15 | IgG1 | UCAVL | 3-1*01 | 1*01 | 0% | 10 |
| 1A102RI6 | 1A102RI6VH | 4-59*01 | 3-16*01 | 4*02 | 7.7% | 15 | IgG1 | I2VL | 3-1*01 | 1*01 | 10.0% | 10 |
| CH106 | CH106VH | 4-59*01 | 3-16*01 | 4*02 | 16.0% | 15 | IgG1 | CH106VL | 3-1*01 | 1*01 | 11.2% | 10 |
| CH103 | CH103VH | 4-59*01 | 3-16*01 | 4*02 | 16.8% | 15 | IgG1 | CH103VL | 3-1*01 | 1*01 | 10.6% | 10 |

FIG. 32 (cont.)

Table 2. (cont.)

| | CH104V H / CH105V H | | | | | CH104 VL | | | |
|---|---|---|---|---|---|---|---|---|---|
| CH104 | 4-59*01 | 3-16*01 | 4*02 | 14.9% | 15 | IgG1 | 3-1*01 | 1*01 | 10.6% | 10 |
| CH105 | 4-59*01 | 3-16*01 | 4*02 | 12.7% | 15 | IgG1 | I2VL | 3-1*01 | 1*01 | 10.0% | 10 |

FIG. 33
Table 3a.

| Virus ID | Clade | IC50[a] | | | | IC80[a] | | | |
|---|---|---|---|---|---|---|---|---|---|
| | | VRC01 | CH31 | b12 | CH103 | VRC01 | CH31 | b12 | CH103 |
| 0260.v5.c36 | A | 0.53 | | >50 | >50 | 1.48 | | >50 | >50 |
| 0330.v4.c3 | A | 0.06 | | | 7.84 | | | >50 | 31.30 |
| 0439.v5.c1 | A | 0.05 | 0.06 | >50 | 8.37 | 0.23 | 0.26 | >50 | >50 |
| 3365.v2.c20 | A | 0.09 | 0.01 | 18.90 | 4.00 | 0.24 | 0.03 | >50 | 40.00 |
| 3415.v1.c1 | A | 0.22 | 0.06 | 6.93 | 2.46 | 0.26 | 0.18 | 13.70 | 4.73 |
| 3718.v3.c11 | A | 0.06 | 0.13 | 12.10 | 29.60 | 4.99 | 0.41 | 43.80 | >50 |
| 398-F1_F6_20 | A | 0.34 | 0.04 | 0.06 | >50 | 0.32 | 0.13 | 1.30 | >50 |
| BB201.B42 | A | 0.09 | >50 | 0.52 | 9.19 | 1.11 | >50 | 3.77 | 40.50 |
| BB539.2B13 | A | 0.15 | 0.01 | 1.42 | 22.20 | 0.33 | 0.04 | 7.40 | >50 |
| BI369.9A | A | 0.03 | 0.02 | 14.90 | >50 | 0.66 | 0.05 | >50 | >50 |
| BS208.B1 | A | 0.56 | 0.11 | 0.04 | >50 | 0.10 | 0.41 | 0.33 | >50 |
| KER2008.12 | A | 0.07 | 0.39 | >50 | 40.00 | 1.74 | 2.32 | >50 | >50 |
| KER2018.11 | A | 0.09 | 0.02 | 49.20 | >50 | 0.40 | 0.10 | >50 | >50 |
| KNH1209.18 | A | | | 0.79 | | 0.30 | | 3.39 | |

FIG. 33 (cont.)

Table 3a. (cont.)

| | | | | | | | | | |
|---|---|---|---|---|---|---|---|---|---|
| MB201.A1 | A | 0.24 | 0.02 | >50 | 17.70 | 0.48 | 0.07 | >50 | >50 |
| MB539.2B7 | A | 0.54 | 0.16 | 14.00 | 3.70 | 1.48 | 0.45 | >50 | 14.20 |
| MI369.A5 | A | 0.16 | 0.03 | 1.58 | >50 | 0.77 | 0.08 | 36.40 | >50 |
| MS208.A1 | A | 0.15 | 0.07 | 0.13 | >50 | 0.67 | 0.21 | 0.98 | >50 |
| Q23.17 | A | 0.09 | | >50 | 10.40 | 0.25 | | >50 | 12.90 |
| Q259.17 | A | 0.05 | 5.09 | >50 | 10.60 | 0.25 | >50 | >50 | 33.90 |
| Q769.d22 | A | 0.02 | 0.03 | >50 | 1.00 | 0.07 | 0.16 | >50 | 2.67 |
| Q842.d12 | A | 0.01 | 0.003 | >50 | 1.46 | 0.02 | 0.01 | >50 | 5.10 |
| QH209.14M.A2 | A | 0.02 | 0.01 | >50 | 1.16 | 0.08 | 0.07 | >50 | 5.75 |
| RW020.2 | A | 0.30 | 0.004 | 10.70 | 23.60 | 0.87 | 0.03 | 21.60 | 47.40 |
| UG037.8 | A | 0.04 | 0.02 | >50 | 1.76 | 0.13 | 0.09 | >50 | 11.90 |
| Breadth | N=25 Titer <50 | 96 | 80 | 56 | 68 | 96 | 76 | 40 | 48 |
| Geometric Mean[b] | | 0.095 | 0.038 | 2.180 | 6.569 | 0.373 | 0.12 | 5.34 | 0.39 |

FIG. 34

Table 3b.

| Virus ID | Clade | IC50[a] | | | | IC80[a] | | | |
|---|---|---|---|---|---|---|---|---|---|
| | | VRC01 | CH31 | b12 | CH103 | VRC01 | CH31 | b12 | CH103 |
| 3988.25 | B | 2.10 | | 2.21 | 9.84 | >50 | | 12.40 | 11.68 |
| 5768.04 | B | 0.10 | 0.10 | 5.62 | 7.08 | 0.94 | 2.37 | >50 | 7.03 |
| 6101.10 | B | 0.10 | | >50 | 1.80 | 0.33 | | >50 | 2.25 |
| 6535.3 | B | 2.16 | | 0.87 | 4.67 | 6.27 | | 18.50 | 3.90 |
| 7165.18 | B | >50 | | >50 | >50 | >50 | | >50 | >50 |
| 45_01dG5 | B | | | | 0.80 | | | | 1.10 |
| 89.6.DG | B | 0.46 | 0.06 | 0.08 | 1.40 | 1.58 | 0.33 | 0.49 | 1.56 |
| AC10.29 | B | 1.43 | | 1.86 | >50 | 3.83 | | 16.30 | >50 |
| ADA.DG | B | 0.42 | 0.21 | 0.13 | 1.49 | 1.40 | 1.07 | 0.73 | 1.82 |
| Bal.01 | B | 0.10 | | 0.09 | 0.68 | 0.32 | | 0.45 | 2.01 |
| BG1168.01 | B | 0.45 | 0.65 | >50 | 21.70 | 1.43 | 2.50 | >50 | >50 |
| BL01.DG | B | >50 | >50 | >50 | >50 | >50 | >50 | >50 | >50 |
| BR07.DG | B | 1.67 | 2.01 | 0.19 | 9.67 | 4.67 | 8.06 | 1.30 | >50 |
| BX08.16 | B | 0.28 | | 0.92 | 1.15 | 0.68 | | 8.16 | 1.07 |
| CAAN.A2 | B | 1.06 | >50 | >50 | >50 | 2.63 | >50 | >50 | >50 |
| CNE10 | B | 0.78 | | >50 | 26.90 | 1.87 | | >50 | >50 |
| CNE12 | B | 0.79 | | >50 | 26.40 | 2.19 | | >50 | >50 |
| CNE14 | B | 0.39 | | 8.28 | 0.52 | 0.98 | | 24.50 | 0.60 |

FIG. 34 (cont.)

Table 3b. (cont.)

| | | | | | | | |
|---|---|---|---|---|---|---|---|
| CNE4 | B | 0.87 | | | | >50 | >50 |
| CNE57 | B | 0.54 | | | | >50 | >50 |
| HO86.8 | B | >50 | | | | >50 | >50 |
| HT593.1 | B | 0.44 | 0.17 | | | 4.51 | >50 |
| HXB2.DG | B | 0.04 | | >50 | 2.36 | 0.01 | 0.23 |
| JRCSF.JB | B | 0.23 | | 16.60 | 1.34 | 1.56 | 1.96 |
| JRFL.JB | B | 0.03 | | >50 | | 0.10 | 0.05 |
| MN.3 | B | 0.03 | | >50 | | 0.002 | 0.54 |
| PVO.04 | B | 0.39 | | 0.25 | 1.72 | >50 | >50 |
| QH0515.01 | B | 0.52 | 0.03 | 0.00 | 0.08 | 12.50 | 4.93 |
| QH0692.42 | B | 1.16 | | 0.22 | 0.80 | 3.05 | >50 |
| REJO.67 | B | 0.05 | | 0.02 | 0.12 | >50 | 5.38 |
| RHPA.7 | B | 0.05 | | 0.03 | 0.07 | 0.58 | 9.20 |
| SC422.8 | B | 0.13 | | <0.0006 | 0.99 | 2.19 | 3.08 |
| SF162.LS | B | 0.24 | | >50 | | 0.15 | 1.19 |
| SS1196.01 | B | 0.28 | | 0.80 | 3.66 | 5.51 | 1.08 |
| THRO.18 | B | 4.42 | | 0.79 | 3.00 | 8.76 | >50 |
| TRJO.58 | B | 0.08 | | 1.70 | 1.47 | >50 | >50 |
| TRO.11 | B | 0.34 | | 0.13 | 0.21 | 0.76 | 5.15 |
| WITO.33 | B | 0.11 | | 0.20 | 0.16 | >50 | 8.53 |
| YU2.DG | B | 0.06 | 0.072 | 0.03 | 0.33 | | 2.00 |
| | | | | 0.78 | 0.63 | | |
| | | | | 0.96 | 0.65 | | |
| | | | | >50 | 15.10 | | |
| | | | | >50 | 0.24 | | |
| | | | | 5.34 | 1.09 | | |
| | | | | 9.67 | | | |
| | | | | 1.46 | 0.27 | 6.34 | |
| Breadth | N=39 Titer <50 | 90 | 21 | 64 | 77 | 87 | 21 | 56 | 59 |
| Geometric Mean[b] | | 0.30 | 0.17 | 0.46 | 2.84 | 0.92 | 1.01 | 1.47 | 1.91 |

FIG. 35

Table 3c.

| Virus ID | Clade | IC50[a] | | | | IC80[a] | | | |
|---|---|---|---|---|---|---|---|---|---|
| | | VRC01 | CH31 | b12 | CH103 | VRC01 | CH31 | b12 | CH103 |
| 286.36 | C | 0.10 | | 0.90 | 8.36 | 1.36 | | 3.18 | 18.80 |
| 288.38 | C | 1.52 | | >50 | 8.45 | 0.38 | | >50 | 19.10 |
| 0013095-2.11 | C | 0.14 | | >50 | 5.71 | 5.86 | | >50 | 25.00 |
| 001428-2.42 | C | 0.01 | | >50 | 1.51 | 0.32 | | >50 | 4.64 |
| 0077_V1.C16 | C | 1.04 | | 0.16 | >50 | 0.04 | | 2.42 | >50 |
| 00836-2.5 | C | 0.13 | | >50 | 28.60 | 3.65 | | >50 | >50 |
| 0921.V2.C14 | C | | | 3.30 | >50 | 0.52 | | 12.70 | >50 |
| 16055-2.3 | C | 0.11 | | >50 | >50 | | | >50 | >50 |
| 16845-2.22 | C | 2.41 | 4.55 | >50 | 5.57 | 0.37 | 27.80 | >50 | >50 |
| 16936-2.21 | C | 0.11 | | >50 | >50 | 9.07 | | >50 | 34.10 |
| 25710-2.43 | C | 0.55 | | >50 | >50 | 0.47 | | >50 | >50 |
| 25711-2.4 | C | 0.71 | | 23.40 | 17.20 | 1.56 | | >50 | 46.00 |
| 25925-2.22 | C | 0.56 | | >50 | 26.70 | 1.70 | | >50 | >50 |
| 26191-2.48 | C | 0.20 | | 1.44 | >50 | 1.39 | | 7.25 | >50 |

FIG. 35 (cont.)

Table 3c. (cont.)

| | | | | | | | |
|---|---|---|---|---|---|---|---|
| 3168.V4.C10 | C | 0.13 | >50 | | | >50 | |
| 3637.V5.C3 | C | 4.09 | >50 | 10.30 | 0.65 | >50 | |
| 3873.V1.C24 | C | 0.95 | >50 | >50 | 0.28 | >50 | |
| 6322.V4.C1 | C | >50 | >50 | >50 | 11.00 | >50 | |
| 6471.V1.C16 | C | >50 | >50 | >50 | 0.33 | >50 | |
| 6631.V3.C10 | C | >50 | >50 | >50 | >50 | >50 | |
| 6644.V2.C33 | C | 0.16 | 0.03 | 0.38 | >50 | 0.36 | 1.51 |
| 6785.V5.C14 | C | 0.33 | 16.50 | 8.95 | 0.53 | >50 | 27.60 |
| 6838.V1.C35 | C | 0.53 | >50 | 29.00 | 0.87 | >50 | >50 |
| 96ZM651.02 | C | 0.27 | >50 | 8.99 | 1.94 | >50 | >50 |
| BR025.9 | C | 1.13 | >50 | >50 | 49.00 | >50 | >50 |
| CAP210.E8 | C | >50 | >50 | >50 | 1.08 | >50 | >50 |
| CAP244.D3 | C | 0.86 | >50 | >50 | >50 | >50 | >50 |
| CAP45.G3 | C | 9.47 | 0.11 | 2.36 | 3.65 | >50 | >50 |

FIG. 35 (cont.)

Table 3c. (cont.)

| | | | | | | | | |
|---|---|---|---|---|---|---|---|---|
| CNE30 | C | 0.93 | | 3.81 | | >50 | | 18.10 | >50 |
| CNE31 | C | 0.96 | | 18.40 | | 2.59 | | >50 | >50 |
| CNE53 | C | 0.11 | | >50 | 6.92 | 2.24 | | >50 | >50 |
| CNE58 | C | 0.12 | | >50 | 0.54 | 0.28 | | >50 | 1.46 |
| DU123.06 | C | 13.60 | | 0.40 | >50 | 0.31 | | >50 | >50 |
| DU151.02 | C | 7.70 | | 16.00 | >50 | >50 | | 5.02 | >50 |
| DU156.12 | C | 0.08 | | 1.41 | >50 | >50 | | >50 | >50 |
| DU172.17 | C | >50 | | 0.55 | >50 | 0.24 | | 4.90 | >50 |
| DU422.01 | C | >50 | | 0.40 | >50 | >50 | | 2.95 | >50 |
| MW965.26 | C | 0.04 | | 0.002 | 0.01 | >50 | 0.32 | 2.17 | >50 |
| SO18.18 | C | 0.07 | 0.07 | 14.30 | 1.88 | 0.12 | >50 | 2.34 | 0.09 |
| TV1.29 | C | >50 | >50 | >50 | >50 | 0.17 | >50 | 47.20 | 7.48 |
| TZA125.17 | C | >50 | >50 | >50 | >50 | >50 | | >50 | >50 |
| TZBD.02 | C | 0.07 | 0.09 | >50 | 5.55 | >50 | 0.34 | >50 | 23.70 |
| ZA012.29 | C | 0.25 | 0.02 | >50 | 28.00 | 0.23 | 0.10 | >50 | >50 |

FIG. 35 (cont.)

Table 3c. (cont.)

| | | | | | | | | | |
|---|---|---|---|---|---|---|---|---|---|
| ZM106.9 | C | 0.25 | | >50 | 4.82 | 0.83 | | >50 | 8.11 |
| ZM109.4 | C | 0.13 | | >50 | 21.20 | 0.64 | | >50 | >50 |
| ZM135.10a | C | 1.28 | | >50 | >50 | 0.39 | | >50 | >50 |
| ZM176.66 | C | 0.04 | 0.01 | >50 | 0.23 | | 2.27 | >50 | 1.25 |
| ZM197.7 | C | 0.62 | | >50 | 35.40 | 1.62 | 0.06 | >50 | >50 |
| ZM214.15 | C | 0.88 | | 4.78 | 41.40 | 0.25 | | | >50 |
| ZM215.8 | C | 0.28 | | >50 | 2.57 | 1.55 | | >50 | >50 |
| ZM233.6 | C | 4.25 | | >50 | 7.35 | 3.04 | | >50 | >50 |
| ZM249.1 | C | 0.08 | | 2.73 | 7.23 | 0.83 | | 14.80 | 37.60 |
| ZM53.12 | C | 0.84 | 4.76 | >50 | >50 | 23.10 | | >50 | >50 |
| ZM55.28a | C | 0.14 | | >50 | 4.59 | 0.24 | 17.00 | >50 | 14.30 |
| Breadth | N=54 Titer <50 | 81 | 13 | 35 | 52 | 76 | 15 | 26 | 30 |
| Geometric Mean[b] | | 0.366 | 0.219 | 1.224 | 5.23 | 0.870 | 1.574 | 4.881 | 8.11 |

FIG. 36

Table 4.

| Antibody | Binding to heterologous HIV-1 Env, EC50 (ug/ml) | | |
|---|---|---|---|
| | AE.427299 gp120 | B.9021 gp140 | C.1086 gp140 |
| UCA | NB | NB | NB |
| I8 | NB | NB | NB |
| I7 | NB | NB | NB |
| 1A102RI6 | NB | NB | NB |
| I4 | NB | NB | 36.2 |
| 1AZCETI5 | NB | >10 | 4.5 |
| I3 | NB | 0.086 | 0.11 |
| I2 | NB | 0.03 | 0.06 |
| I1 | NB | 0.066 | 0.12 |
| 1AH92U | NB | 3.2 | 0.16 |

FIG. 36 (cont.)

Table 4. (cont.)

| | | | |
|---|---|---|---|
| CH104 | NB | 0.063 | 0.06 |
| CH103 | NB | 0.5 | 0.07 |
| CH106 | NB | 0.06 | 0.22 |
| CH105 | NB | 0.09 | 0.11 |

FIG. 37

Table 5.

| CH103UCAs | Binding affinity to autologous Envs | | |
|---|---|---|---|
| | $k_a$ (x $10^3$ $M^{-1}s^{-1}$) | $k_d$ (x $10^{-3}$ $s^{-1}$) | $K_d$, nM |
| CH103UCA-1 | 26.7 | 0.926 | 37.5 |
| CH103UCA-2,3,5[b] | 20.5 | 2.9 | 141.5 |
| CH103UCA-4 | 27.2 | 1.0 | 36.8 |
| CH103UCA-6 | 25.0 | 6.6 | 264.0 |

DNA sequence alignment of V$_H$DJ$_H$ CH103 UCAs: (SEQ ID NOS 1-6, respectively, in order of appearance)

```
CH103UCA    CAGGTGCAGC TGCAGGAGTC GGGCCCAGGA CTGGTGAAGC CTTCGGAGAC CCTGTCCCTC
CH103UCA-2  ---------- ---------- ---------- ---------- ---------- ----------
CH103UCA-3  ---------- ---------- ---------- ---------- ---------- ----------
CH103UCA-4  ---------- ---------- ---------- ---------- ---------- ----------
CH103UCA-5  ---------- ---------- ---------- ---------- ---------- ----------
CH103UCA-6  ---------- ---------- ---------- ---------- ---------- ----------  60

CH103UCA    ACCTGCACTG TCTCTGGTGG CTCCATCAGT AGTTACTACT GGAGCTGGAT CCGGCAGCCC CCAGGGAAGG
CH103UCA-2  ---------- ---------- ---------- ---------- ---------- ---------- ----------
CH103UCA-3  ---------- ---------- ---------- ---------- ---------- ---------- ----------
CH103UCA-4  ---------- ---------- ---------- ---------- ---------- ---------- ----------
CH103UCA-5  ---------- ---------- ---------- ---------- ---------- ---------- ----------
```

FIG. 37 (cont.)

Table 5. (cont.)

```
CH103UCA-6    ------------ ------------ ------------ ------------ ------------ ------------ ------------ = 130
CH103UCA      GACTGGAGTG   GATTGGGTAT   ATCTATTACA   GTGGGAGCAC   CAACTACAAC   CCCTCCCTCA   AGAGTGGAGT
CH103UCA-2    ------------ ------------ ------------ ------------ ------------ ------------ ------------
CH103UCA-3    ------------ ------------ ------------ ------------ ------------ ------------ ------------
CH103UCA-4    ------------ ------------ ------------ ------------ ------------ ------------ ------------
CH103UCA-5    ------------ ------------ ------------ ------------ ------------ ------------ ------------
CH103UCA-6    ------------ ------------ ------------ ------------ ------------ ------------ ------------ = 200

CH103UCA      CACCATATCA   GTAGACACGT   CCAAGAACCA   ATTCTCCCTG   AAGCTGAGCT   CTGTGACCGC
CH103UCA-2    ------------ ------------ ------------ G----------- ------------ ------------
CH103UCA-3    ------------ ------------ ------------ G----------- ------------ ------------
CH103UCA-4    ------------ ------------ ------------ G----------- ------------ ------------
CH103UCA-5    ------------ ------------ ------------ G----------- ------------ ------------
CH103UCA-6    ------------ ------------ ------------ ------------ ------------ ------------ = 260

CH103UCA      TGCGGACACG   GCCGTGTATT   ACTGTGCCAG   CCTGCCCAGG   GGGCAGTTAG   TCAATGCCTA
CH103UCA-2    ------------ ------------ ------------ ------------ ---G-------- ------------
CH103UCA-3    ------------ ------------ ------------ ------------ ---G-------- ------------
CH103UCA-4    ------------ ------------ ------------ ------------ --A---A----- ------C-----
CH103UCA-5    ------------ ------------ ------------ ------------ ---G-------- ------C-----
CH103UCA-6    ------------ ------------ ------------ ------------ ---G-------- ---CG------- = 320

CH103UCA      CTTTGACTAC   TGGGGCCAGG   GAACCCTGGT   CACCGTCTCC   TCA
CH103UCA-2    ------------ ------------ ------------ ------------ ---
CH103UCA-3    ------------ ------------ ------------ ------------ ---
CH103UCA-4    ------------ ------------ ------------ ------------ ---
CH103UCA-5    ------------ ------------ ------------ ------------ ---
CH103UCA-6    ------------ ------------ ------------ ------------ --- = 363
```

FIG. 37 (cont.)

Table 5. (cont.)

Amino acid sequence alignment of $V_H DJ_H$ CH103 UCAs: (SEQ ID NOS 7-12, respectively, in order of appearance)

```
CH103UCA-1   QVQLQESGPG LVKPSETLSL TCTVSGGSIS SYWWSWIRQP PGKGLEWIGY IYYSGSTNYN
CH103UCA-2   ---------- ---------- ---------- ---------- ---------- ----------
CH103UCA-3   ---------- ---------- ---------- ---------- ---------- ----------
CH103UCA-4   ---------- ---------- ---------- ---------- ---------- ----------
CH103UCA-5   ---------- ---------- ---------- ---------- ---------- ----------
CH103UCA-6   ---------- ---------- ---------- ---------- ---------- ----------  60

CH103UCA-1   PSLKSRVTIS VDTSKNQFSL KLSSVTAADT AVYYCASLPR GQLVNAYFDY WGQGTLVTVS S
CH103UCA-2   ---------- ---------- ---------- ---------- --E------- ---------- -
CH103UCA-3   ---------- ---------- ---------- ---------- --E------- ---------- -
CH103UCA-4   ---------- ---------- ---------- ---------- ---I------ ---------- -
CH103UCA-5   ---------- ---------- ---------- ---------- --E------- ---------- -
CH103UCA-6   ---------- ---------- ---------- ---------- --E--R---- ---------- -  121
```

FIG. 38

Table 6.

*Apparent binding affinity of autologous Envs to CH103 clonal lineage antibodies, EC50, ug/ml

| Autologous Env | UCA | I8 | I4 | I3 | I2 | I1 | CH105 | CH103 | CH104 | CH106 |
|---|---|---|---|---|---|---|---|---|---|---|
| CH0505 T/F | 2 | 1.1 | 0.3 | 0.12 | 0.09 | 0.11 | 0.1 | 0.08 | 0.12 | 0.08 |
| CH0505.w30.e16 | NB | >10 | 2.1 | 0.07 | 0.047 | 0.06 | 0.064 | 0.055 | 0.05 | 0.05 |
| CH0505.w30.e23 | NB | NB | >20 | 0.14 | 0.07 | 0.09 | 0.08 | 0.044 | 0.07 | 0.053 |
| CH505.w53.e16 | NB | NB | NB | 0.066 | 0.03 | 0.05 | 0.05 | 0.03 | 0.036 | 0.032 |
| CH505.w78.e7 | NB | NB | NB | 0.13 | 0.054 | 0.083 | 0.09 | 0.043 | 0.1 | 0.13 |
| CH505.w78.e16 | NB | NB | NB | NB | 0.2 | >10 | 0.3 | 1.2 | 0.19 | 0.14 |
| CH505.w78.e38 | NB | NB | NB | >100 | >100 | >10 | >10 | >10 | >10 | >10 |

FIG. 39

Table 7.

```
>UCA_VHDJH
QVQLQESGPGLVKPSETLSLTCTVSGGSISSYYWSWIRQPPGKGLEWIGYIYYSGSTNYNPSLKSRVTISVDTSKNQFSLKLSSVTAADTAVYY
CASLPRGQLVNAYFDYWGQGTLVTVSS (SEQ ID NO: 7)
>IZ95W_VHDJH
QVQLQESGPGLVKPSETLSLTCTVSGGSIVSYYWSWIRQPPGKGLEWIGYMYYSGSTNYNPSLKSRVTISIDTSKNQFSLKLRSVTAADTAVYY
CASLPRGQLILGYFDYWGQGTLVTVSS (SEQ ID NO: 13)
>O2IV4_VHDJH
QVQLQESGSGLVKPSETLSLTCTVSGGSISSYYWSWIRQPPGKGLEWIGFIYYSGSTNYNPSLKSRVTISIDTSKNQFSLKLRSVTAADTAVYY
CASLPRGQLILGYFDYWGQGTLVTVSS (SEQ ID NO: 14)
```

| | | | | | |
|---|---|---|---|---|---|
| UCA_VHDJH   | QVQLQESGPG | LVKPSETLSL | TCTVSGGSIS | SYYWSWIRQP | PGKGLEWIGY IYYSGSTNYN |
| IZ95W_VHDJH | ---------- | ---------- | ---------V | ---------- | ---------- M--------- |
| O2IV4_VHDJH | --------S- | ---------- | ---------- | ---------- | ---------F ---------- 60 |

| | | | | | |
|---|---|---|---|---|---|
| UCA_VHDJH   | PSLKSRVTIS | VDTSKNQFSL | KLSSVTAADT | AVYYCASLPR | GQLVNAYFDY WGQGTLVTVS |
| IZ95W_VHDJH | ---------I | ---------- | ---R------ | ---------- | ----ILG--- ---------- |
| O2IV4_VHDJH | ---------I | ---------- | ---R------ | ---------- | ----ILG--- ---------- 120 |

| | | |
|---|---|---|
| CUCA_VHDJH   | S   | (SEQ ID NO: 7) |
| IZ95W_VHDJH  | -   | (SEQ ID NO: 13) |
| O2IV4_VHDJH  | - 121 | (SEQ ID NO: 14) |

FIG. 40

Table 8.

|  | CH103:gp120 | Fab CH103 |
|---|---|---|
| PDB accession code | To be deposited | To be deposited |
| Data collection | | |
| Space group | $P2_1$ | $P2_1$ |
| Cell constants | | |
| $a, b, c$ (Å) | 48.9, 208.7, 69.4 | 43.0, 146.4, 66.322 |
| $\alpha, \beta, \gamma$ (°) | 90.0, 107.2, 90.0 | 90.0, 97.7, 90.0 |
| Wavelength (Å) | 1.00 | 1.00 |
| Resolution (Å) | 50-3.20 (3.20-3.20)* | 50-1.65(1.68-1.65) |
| $R_{merge}$ | 13.4 (44.4) | 6.7(53.1) |
| $I / \sigma I$ | 9.6 (1.9) | 30.0 (1.7) |
| Completeness (%) | 89.4 (52.3) | 98.4 (90.0) |
| Redundancy | 3.4 (2.4) | 3.4 (2.3) |
| Refinement | | |
| Resolution (Å) | 3.20 | 1.65 |
| No. reflections | 68,668 | 319,139 |
| $R_{work} / R_{free}$ (%) | 19.1/25.3 | 17.8/20.1 |
| No. atoms | 17821 | 13319 |
| Protein | 8837 | 6428 |
| Ligand/ion | 154 | 0 |
| Water | 23 | 597 |
| $B$-factors | 88.7 | 28.3 |
| Protein | 88.7 | 27.7 |
| Solvent | 46.9 | 34.80 |
| R.m.s. deviations | | |
| Bond lengths (Å) | 0.004 | 0.004 |
| Bond angles (°) | 0.735 | 0.967 |
| Ramachandran | | |
| Most favored regions (%) | 92.5 | 96.8 |
| Additional allowed regions (%) | 7.0 | 2.8 |
| Disallowed regions (%) | 0.5 | 0.4 |

FIG. 41

Table 9.

| HIV-1 gp120 | | | Residue-by-residue binding surface on HIV-1 gp120 (Å²) * | | | | | | | |
|---|---|---|---|---|---|---|---|---|---|---|
| | Residue | | HIV-1 gp120 interacting molecule (PDB code) | | | | | | | |
| Region | Number | Type | CD4 (2NXY) | CH103 (XXXX) | b12 (2NY7) | b13 (3IDX) | F105 (3HI1) | VRC01 (3NGB) | VRC03 (3SE8) | VRC-PG04 (3SE9) | NIH45-46 (3U7Y) |
| | 49 | D | | | | | | | | | 4.8 |
| | 96 | W | | | | | | | | | 7.1 |
| | 97 | K | | | | | | 26.4 | 41.0 | 10.5 | 44.0 |
| | 99 | D | | | | | | | | | 22.1 |
| | 102 | E | | | | | | | | | 33.8 |
| α1 | 105 | H | | | | | 2.9 | | | | |
| | 108 | I | | | | | 2.8 | | | | |
| | 109 | I | | | | | 28.7 | | | | |
| | 112 | W | | | | | 69.9 | | | | |
| | 122 | L | | | | | | | | | 3.3 |
| | 123 | T | | | | | | | 8.5 | 3.1 | 5.6 |
| | 124 | P | 39.9 | | | | | 36.8 | 81.7 | 31.2 | 33.8 |
| | 125 | L | 6.7 | | | | | | | | |
| | 126 | C | 61.5 | | | | | | | | |
| | 127 | V | 30.8 | | | | | | | | |
| V1/V2 | 196 | C | 5.5 | | | | | | | | |
| | 198 | T | | | | | | 12.7 | 51.3 | | |
| | 199 | S | | | | | | | 13.4 | | |

FIG. 41 (cont.)

Table 9. (cont.)

| | | | | | | | | | |
|---|---|---|---|---|---|---|---|---|---|
| β4/5 | 210 | F | | | | | 5.3 | | |
| | 226 | L | | | | | 11.8 | | |
| | 244 | T | | | | | 5.7 | | |
| Loop B | 255 | V | | 56.6 | | | | | |
| | 256 | S | | | 15.0 | | 18.1 | | |
| | 257 | T | | | | | 10.9 | 6.9 | |
| Loop D | 275 | V | | | | | | | 26.2 | 11.1 |
| | 276 | N | | | | | | 13.3 | 17.7 | 9.9 |
| | 278 | T | | | | | 22.6 | 73.0 | 35.2 | 36.7 |
| | 279 | D | 18.5 | 3.9 | | 6.6 | 84.4 | 36.5 | 51.7 | 57.5 |
| | 280 | N | 51.1 | 94.9 | 13.0 | 14.3 | 56.5 | 76.3 | 72.0 | 69.7 |
| | 281 | A | 74.7 | | 29.8 | 52.2 | 70.2 | 70.8 | 74.0 | 75.7 |
| | 282 | K | 31.6 | | | 16.7 | 69.6 | 17.2 | 31.9 | 49.7 |
| | 283 | T | 18.2 | | 12.6 | | 30.5 | 8.2 | 10.6 | 5.2 |
| | | | | | | | 11.9 | | | |
| β15/α3 CD4-binging loop | 364 | S | 65.6 | 18.9 | 11.5 | 25.5 | 61.5 | 58.0 | 46.0 | 59.1 |
| | 365 | S | 24.6 | 85.9 | 29.5 | 53.8 | 22.0 | 23.3 | 22.0 | 21.1 |
| | 366 | G | 38.6 | 16.7 | 61.7 | 37.4 | 24.1 | 26.4 | 22.9 | 26.2 |
| | 367 | G | 69.5 | 71.1 | 74.4 | 87.3 | 48.6 | 54.2 | 51.2 | 47.4 |
| | 368 | D | | 64.0 | 64.6 | 87.0 | | | | |
| | 369 | P | | 19.4 | 59.7 | 62.9 | | | | |
| | 370 | E | 14.7 | 30.1 | 14.7 | 26.4 | 44.1 | 16.0 | 44.8 | 60.4 |
| | 371 | I | 39.6 | 39.8 | 80.8 | 61.8 | | 35.2 | | |

FIG. 41 (cont.)

Table 9, (cont.)

| | | | | | |
|---|---|---|---|---|---|
| | 372 | V | 30.9 | 25.8 | |
| | 373 | T | 17.3 | 11.7 | |
| | 375 | S | | 9.2 | 7.0 |
| | 382 | F | 4.6 | 16.2 | 36.2 |
| β17 | 384 | Y | 35.9 | 2.8 | 7.2 |
| | 386 | N | | | |
| | 417 | P | 16.3 | | |
| β18 | 418 | C | 2.2 | | |
| | 419 | R | 84.7 | 64.8 | 3.3 |

FIG. 41 (cont.)

Table 9. (cont.)

| HIV-1 gp120 | | | Residue-by-residue binding surface on HIV-1 gp120 (Å²) * | | | | | | | |
|---|---|---|---|---|---|---|---|---|---|---|
| | | | HIV-1 gp120 interacting molecule (PDB code) | | | | | | | |
| Region | Residue Number | Type | CD4 (2NXY) | CH103 (XXXX) | b12 (2NY7) | b13 (3IDX) | F105 (3HI1) | VRC01 (3NGB) | VRC03 (3SE8) | VRC-PG04 (3SE9) | NIH45-46 (3U7Y) |
| β20/21 Bridging sheet | 421 | K | | | | 40.2 | 54.1 | | | | |
| | 424 | I | | | | | 4.3 | | | | |
| | 425 | N | 24.5 | | | 60.7 | 18.2 | | 12.1 | | |
| | 426 | M | 14.4 | | | 12.5 | 79.1 | | 7.1 | | |
| | 427 | W | 28.2 | | | | | 7.6 | 35.1 | | 12.8 |
| | 428 | Q | | | | | | 4.7 | | | |
| | 429 | K | 14.9 | | 31.1 | | 63.0 | 2.1 | 49.7 | 47.6 | 23.7 |
| | 430 | V | 111.5 | | 13.2 | | | 58.3 | | | 57.3 |
| | 431 | G | | | 47.8 | | | | 13.8 | 7.0 | 11.3 |
| | 432 | K | | | | | | | | | 8.0 |
| β 23 | 455 | T | 15.5 | 18.6 | 28.3 | 3.5 | 9.6 | 31.2 | 24.0 | 32.9 | 31.9 |
| | 456 | R | 3.6 | | 5.4 | | | 5.8 | 6.4 | 2.4 | 6.8 |
| | 457 | D | 37.4 | 49.1 | | | | 46.4 | 43.7 | 27.1 | 45.8 |

FIG. 41 (cont.)

Table 9. (cont.)

| | | | | | | |
|---|---|---|---|---|---|---|
| Loop V5 | 458 | G | | 32.5 | 50.5 | | |
| | 459 | G | 32.2 | 48.9 | 69.1 | 35.2 | 44.9 |
| | 460 | N | 64.8 | 53.3 | 37.1 | 62.9 | 39.4 68.8 |
| | 461 | S | | 66.1 | 67.8 | 63.9 | 56.8 24.1 |
| | 462 | N | | 36.2 | | 51.2 | 66.3 54.9 |
| | 463 | N | | 16.9 | | 28.9 | 26.7 6.6 |
| | | | | | 13.7 | 15.4 | 10.2 |
| β24 | 465 | S | | | 9.7 | 9.4 | 8.7 |
| | 466 | G | | | 6.0 | | 2.1 |
| | 467 | I | | | 11.3 | 15.9 | 17.8 |
| | 469 | R | 13.5 | 59.4 | 23.3 | 21.8 | 17.2 21.0 |

FIG. 41 (cont.)

Table 9. (cont.)

| | | | | | | | | | |
|---|---|---|---|---|---|---|---|---|---|
| Outer domain exiting loop | 471 | G | | 4.2 | | 4.2 | | | |
| | 472 | G | 20.5 | 6.6 | 20.5 | 6.3 | 8.4 | 23.7 | 3.6 | 4.8 |
| | 473 | G | 23.4 | | 53.5 | 23.8 | 27.6 | 29.2 | 18.3 | 22.8 |
| | 474 | D | 37.2 | | 26.0 | 25.3 | 17.3 | 3.0 | 7.6 | 30.5 |
| | 475 | M | 2.8 | | 65.0 | | | | | 4.2 |
| α5 | 476 | R | 9.3 | | | | 40.9 | | 21.9 | 24.8 |
| | 477 | D | 3.7 | | | | 3.1 | | | |
| | 480 | R | | | | | | | | 16.4 |

FIG. 42

Table 10.

Supplementary Table 10a.

| Antibody | Interface on gp120 (Å²) | Interface on CH103 (Å²) | |
|---|---|---|---|
| | | Total antibody area | Area contributed by UCA residues (% total) |
| Heavy chain | 429 | 493 | 414 (84%) |
| Light chain | 378 | 377 | 164 (44%) |
| Total | 807 | 870 | 578 (66%) |

Table 10b.

| gp120 residue | | | Heavy chain interactions | | Light chain interactions | |
|---|---|---|---|---|---|---|
| Region | Number | Type | Bond type* | Surface area (Å²) | Bond type | Surface area (Å²) |
| Loop B | 256 | SER | H | 11.72 | | |
| Loop D | 279 | ASP | | | | 3.56 |
| | 280 | ASN | | 12.38 | H | 39.83 |
| CD4-binding loop | 364 | HIS | | 13.21 | | 3.56 |
| | 365 | SER | H | 53.96 | | 31.86 |
| | 366 | GLY | | 17.71 | | 3.61 |
| | 367 | GLY | H | 68.46 | | |
| | 368 | ASP | HS | 65.44 | | |
| | 369 | LEU | H | 18.72 | | |
| | 370 | GLU | HS | 28.69 | | |
| | 371 | ILE | | 38.90 | | |
| Loop V5 | 455 | THR | | 18.59 | | |
| | 457 | ASP | | 35.32 | | 13.05 |
| | 458 | GLY | | 9.87 | H | 24.12 |
| | 459 | GLY | | | | 50.36 |
| | 460 | ASN | | 50.77 | | 50.77 |
| | 461 | ASP | | | HS | 69.50 |
| | 462 | ASP | | | | 36.60 |
| | 463 | ASN | | | | 15.46 |
| 24 | 469 | ARG | | 23.84 | | 34.44 |
| | 471 | GLY | | 5.35 | | |
| | 472 | GLY | | 5.85 | | |

FIG. 42 (cont.)

Table 10c.

| Chain | Region | Residue Number (Kabat) | Type | Bond type* | Buried surface area (Å²) | Contribution by Region (%) |
|---|---|---|---|---|---|---|
| H | CDR H1 | 33 | TYR | H | 32.31 | 3.7 |
| H |  | 50 | TYR | H | 21.67 |  |
| H |  | 52 | PHE |  | 12.11 |  |
| H | CDR H2 | 54 | THR |  | 7.68 | 11.8 |
| H |  | 56 | GLU | H | 59.46 |  |
| H |  | 58 | ASN |  | 2.01 |  |
| H |  | 97 | ARG | HS | 82.19 |  |
| H |  | 98 | GLY |  | 23.45 |  |
| H | CDR H3 | 99 | GLN | H | 120.00 | 41.1 |
| H |  | 100 | LEU | H | 27.19 |  |
| H |  | 100A | VAL | H | 55.44 |  |
| H |  | 100B | ASN |  | 50.10 |  |
| L |  | 27 | SER |  | 3.68 |  |
| L | CDR L1 | 31 | THR |  | 14.17 | 8.0 |
| L |  | 32 | ASN | H | 52.10 |  |
| L |  | 50 | GLU | H | 38.67 |  |
| L | CDR L2 | 51 | ASN | H | 27.91 | 14.0 |
| L |  | 52 | TYR |  | 32.84 |  |
| L |  | 53 | LYS | H | 22.45 |  |
| L |  | 65 | SER |  | 9.04 |  |
| L | FWR L3 | 66 | LYS | HS | 43.83 | 13.1 |
| L |  | 67 | SER |  | 25.47 |  |
| L |  | 68 | GLY |  | 36.10 |  |
| L | CDR L3 | 91 | TRP |  | 70.62 | 8.1 |

FIG. 43

Table 11.

| | Hydrogen bonds | | | | | | |
|---|---|---|---|---|---|---|---|
| | Antibody CH103 | | | Distance | gp120 | | |
| Chain | Number | Type | Atom | (Å) | Atom | Type | Number |
| H | 33 | TYR | OH | 2.17 | OD1 | ASP | 368 |
| H | 50 | TYR | OH | 3.68 | O | GLY | 367 |
| H | 56 | GLU | OE1 | 3.20 | N | LEU | 369 |
| H | 97 | ARG | NH1 | 3.81 | OG | SER | 256 |
| H | 97 | ARG | NH2 | 2.59 | OE1 | GLU | 370 |
| H | 99 | GLN | NE2 | 3.10 | OG | SER | 365 |
| H | 100 | LEU | N | 2.41 | O | SER | 365 |
| H | 100 | LEU | N | 3.22 | OG | SER | 365 |
| H | 100A | VAL | N | 3.18 | OG | SER | 365 |
| L | 32 | ASN | ND2 | 2.97 | O | GLY | 458 |
| L | 50 | GLU | OE2 | 3.07 | ND2 | ASN | 280 |
| L | 51 | ASN | ND2 | 2.92 | OD1 | ASP | 461 |
| L | 53 | LYS | NZ | 3.19 | OD1 | ASN | 280 |
| L | 66 | LYS | NZ | 3.16 | OD2 | ASP | 461 |

| | Salt bridges | | | | | | |
|---|---|---|---|---|---|---|---|
| | Antibody CH103 | | | Distance | gp120 | | |
| Chain | Number | Type | Atom | (Å) | Atom | Type | Number |
| H | 97 | ARG | NE | 3.93 | OD1 | ASP | 368 |
| H | 97 | ARG | NE | 2.58 | OD2 | ASP | 368 |
| H | 97 | ARG | NH2 | 2.59 | OE1 | GLU | 370 |
| H | 97 | ARG | NH2 | 2.73 | OD2 | ASP | 368 |
| L | 66 | LYS | NZ | 3.65 | OD1 | ASP | 461 |
| L | 66 | LYS | NZ | 3.16 | OD2 | ASP | 461 |

FIG. 44

Table 12.

Heavy chain mutations

| Region | ID | UCA | Mature | Paratope | Description and note |
|---|---|---|---|---|---|
| FWR 1 | 11 | L | V | | Shortens side chain on strand A |
| | 14 | P | S | | Alters loop between strands A and B |
| | 29 | I | M | | Enhances interactions with heavy chain Trp34 |
| | 30 | S | G | | Increases loop flexibility |
| CDR 1 | 31 | S | G | | Increases CDR 1 flexibility |
| | 32 | Y | T | | Avoids clash with other heavy chain residues |
| FWR 1 | 37 | I | L | | Neutral mutation |
| | 39 | Q | L | | Alters heavy/light chain interface |
| | 40 | P | S | | Allows flexibility in strand C |
| CDR 2 | 52 | Y | F | Yes | Polar to hydrophobic |
| | 53 | Y | H | Yes | Polar to basic |
| | 54 | S | T | Yes | Adds carbon to paratope interface |
| | 56 | S | E | Yes | Forms hydrogen bond with backbone amide of Leu369 in the CD4-binding loop |
| | 60 | N | S | | Alters heavy/light chain interface |
| FWR 3 | 65 | S | G | | Increases flexibility in loop between strand C" and D |
| | 68 | T | S | | Avoids clashes with neighboring residues |
| | 75 | K | E | | Basic to acidic change in loop between strand D and E |
| | 76 | N | D | | Polar to acidic change at the beginning of strand E |
| | 81 | K | R | | Neutral mutation |
| | 82A | S | R | | Polar to basic change at C terminus of strand E |
| | 91 | Y | F | | Polar to hydrophobic change at the heavy/light chain interface |
| CDR 3 | 101 | D | R | | Acidic to basic change at the first layer adjacent to paratope |
| | 102 | Y | N | | Smaller side chain at the end of CDR H3 |

FIG. 44 (cont.)

Table 12. (cont.)

| Region | ID | UCA | Mature | Description |
|---|---|---|---|---|
| FWR 4 | 105 | Q | R | Alters heavy/light chain interface |
| | 107 | T | S | Avoids clashes with neighboring residues |
| | 110 | T | S | Alters heavy/light chain interface |
| | 112 | S | T | Minor change at the end of strand G |
| | 113 | S | A | Avoids clashes with neighboring residues |

Light chain mutations

| Region | ID | UCA | Mature | Paratope | Description and note |
|---|---|---|---|---|---|
| FWR 1 | 20 | S | T | | Surface residue in strand B |
| CDR 1 | 26 | D | A | | Avoids clashes with neighboring residues |
| | 27 | K | . | | Deletion reduces potential clashes with HIV-1 gp120 |
| | 27A | L | . | | Deletion reduces potential clashes with HIV-1 gp120 |
| | 27B | G | . | | Deletion reduces potential clashes with HIV-1 gp120 |
| | 27C | D | S | Yes | Acidic to polar change |
| | 31 | K | T | Yes | Shorter side chain reduces potential clashes with HIV-1 gp120 |
| | 32 | Y | N | Yes | Smaller side chain reduces potential clashes with HIV-1 gp120 |
| | 33 | A | V | | Bulker side chain increases packing of light chain core |
| FWR 2 | 38 | Q | V | | Alters heavy/light chain interface |
| | 45 | V | E | | Surface residue at strand C', hydrophobic to acidic change |
| | 46 | L | V | | Alters heavy/light chain interface |
| | 49 | Y | F | | Alters heavy/light chain interface |
| CDR 2 | 50 | Q | E | Yes | Forms hydrogen bond with Asn280 in gp120 loop D |

FIG. 44 (cont.)

Table 12. (cont.)

| | | | | | |
|---|---|---|---|---|---|
| | 51 | D | N | Yes | Forms hydrogen bond with Asn461 in gp120 loop V5 |
| | 52 | S | Y | Yes | Enhances interactions with gp120 loop D |
| | 60 | E | D | | Surface residue in loop between strands C" and D |
| | 66 | N | K | Yes | Forms hydrogen bond and salt bridges with Asn461 in loop V5 |
| FWR 3 | 69 | N | S | | Shortens side chain in loop between strands D and E |
| | 76 | S | R | | Polar to basic change and longer side chain at C terminus of strand E |
| | 81 | M | I | | Shortens side chain in loop between strands E and F |
| CDR 3 | 90 | A | V | | Bulker side chain increases packing of light chain core |
| FWR 4 | 100 | T | S | | Neutral mutation in strand G and near heavy/light chain interface |

FIG. 45

Table 13.

| Week after infection | Using FEL | | | | | | | Using MEME | | |
|---|---|---|---|---|---|---|---|---|---|---|
| | n Neg[a] | n Pos[b] | CH103 n Neg[c] | Non-CH103 n Pos[d] | Fisher's p (n Pos)[e] | Fisher's p (n Neg)[f] | Substitution per site[g] | selected sites | Positively selected sites inside CH103 footprint | Positively selected sites outside CH103 footprint | Fisher's exact P value |
| 4 | 0 | 6 | 0 | 0 | na | 1 | 0.0035 | 0 | 0 | 0 | na |
| 14 | 0 | 14 | 0 | 0 | na | 1 | 0.0095 | 0 | 0 | 0 | na |
| 20 | 5 | 20 | 3 | 2 | 0.009 | 0.71 | 0.022 | 3 | 2/92 | 1/830 | 0.05 |
| 30 | 8 | 32 | 4 | 4 | 0.005 | 0.36 | 0.04 | 5 | 3/92 | 2/830 | 0.009 |
| 160 | 36 | 88 | 11 | 25 | 0.0004 | 0.6 | 0.057 | 34 | 11/92 | 23/830 | 0.0002 |

FIG. 46

Table 14.

| Antibody ID | Neutralization activity (IC50, ug/ml) | | | | | | | |
|---|---|---|---|---|---|---|---|---|
| | C.CH505 T/F | Heterologous viruses | | | | | | MuLV |
| | | B.SF162 | B.JRFL | A.Q168 | A.Q842 | B.BG1168 | C.ZM106 | |
| UCA | >50 | >50 | >50 | >50 | >50 | >50 | >50 | >50 |
| I8 | 49.4 | >50 | >50 | >50 | >50 | >50 | >50 | >50 |
| I7 | 14.7 | >50 | >50 | >50 | >50 | >50 | >50 | >50 |
| I4 | 10.9 | >50 | >50 | >50 | >50 | >50 | >50 | >50 |
| IAZCETI5 | 12.8 | >50 | >50 | >50 | >50 | >50 | >50 | >50 |
| IA102RI6 | 4.6 | >50 | >50 | >50 | >50 | >50 | >50 | >50 |
| IAH92U | >50 | 22.0 | >50 | >50 | >50 | >50 | >50 | >50 |
| I3 | 6.2 | 1.2 | 0.071 | 24.1 | >50 | 42.6 | >50 | >50 |
| I2 | 1.5 | 1.1 | <0.023 | 2.6 | 3.7 | 14.7 | 17.0 | >50 |
| I1 | 2.5 | 0.211 | <0.023 | 2.2 | 1.8 | 15.4 | 19.4 | >50 |

FIG. 46 (cont.)

Table 14. (cont.)

| | | | | | | | |
|---|---|---|---|---|---|---|---|
| CH103 | 3.2 | 0.316 | 0.033 | 2.3 | 1.4 | 17.7 | 12.8 | >50 |
| CH104 | 2.0 | 0.096 | 0.025 | 2.7 | 2.4 | 13.4 | 12.0 | >50 |
| CH105 | 4.9 | 0.562 | 0.038 | 5.5 | 40.0 | 15.8 | 28.5 | >50 |
| CH106 | 2.3 | 0.121 | <0.023 | 1.6 | 0.6 | 8.2 | 8.1 | >50 |

| >50 | >20 - <50 | >10 - <20 | >5 - <10 | <5 |
|---|---|---|---|---|

FIG. 47

Table 15.

```
C.CH0505T/F  MRVMGIQRNY PQW.WIWSML GFWMLMICNG ....MWVTVY YGVPVWKEAK TTLFCASDAK
A.Q168       --K-R--K--L ....-K-GTM LLG--TYSV .AEQL----- --------D-E ----------
A.Q842       ---A----M-C QNL.-R-GTM ILG-IIF-SA .VDNL----- ---------E ----------
B.BG1168     ---K--MK-C QHL.-R-GIM LLGI----SA .TEKL----- ---------T ----------
B.JRFL       ----K--RK- QHL.--RGGT- LLGTIV---- .VEKL----- ---------T ----------
B.SF162      ---K--RK-- QHL.--RGGT- LLG-----SA .VEKL----- ---------T ----------
C.ZM106      --K-RE-L--W R--.---GI-- --------V VVGNL----- ---------T ----------
B.HXB2       ---KEKYQHL WR-G-R-GTM LLG-----SA .TEKL----- ---------T ----------
                                                                              60

C.CH0505T/F  AYEKEVHNVW ATHACVPTDP NPQEMVLKNV TENFNMWKND MVDQMHEDVI SLWDQSLKPC
A.Q168       --ST-K--I- ---------- ----IH-E-- ----E----- --E----T-I ---------R-
A.Q842       --T-K----- ---------- ----IH-E-- ----E----- --E----T-I ----------
B.BG1168     ---T------ ---------- ----VK-E-- ----D--V-- ---T-----I ----------
B.JRFL       --DT------ ---------- ------V--G ----K----- --E----Q--I ----------
B.SF162      --DT------ ---------- ------I--E ----I-E--- --E------I ----------
C.ZM106      ---R------ ---------- ----S----E ---------- ---------I ----------
B.HXB2       --DT------ ---------- ------V--V ---------- --E------I ----------
                                                                              120

C.CH0505T/F  VKLTPLCVTL NCTNA..... .......T..A SNSSI...I. .......EGM KNCSFNITTE
A.Q168       ---------- -----VN... .....----N V-NNT...G. .......WD-ER ----------
A.Q842       ---------- D-N-VT.... ....-NNG..S DM.....R.. ........EI ------M--S
B.BG1168     ---------- H--DVNTTCI TTNNS-MTNS -----TEGNCS SYNYNGR-EL R--------S
B.JRFL       ---------- ---KDV.... ....-KDV... ..NA-NTTN GSEGTM.... ...ERGEI--S
B.SF162      ---------- ---H--L... ....-KNA-NTKS --WKEM.... ....DRGEI --KV--S
C.ZM106      ---------- K-V-V..... ....-NA-SKSN ASATNDG... .....SGE-- ---T----S
B.HXB2       -------S-- K---DL.... ....-KND-NTNS -SGRMIM..E .....KGEI --S--S
                                                                              180

C.CH0505T/F  LRDKREKKNA LFYKLDIVQL ...DGNSSQ. .YRLINCNTS VITQACPKVS FDPIPIHYCA
A.Q168       -------Q-VYS -------V--I ....-DN-S. .--------- A--------- --E-------
A.Q842       -------Q-VYS ---------I NEDQ----NN K----T---- A--------T --E-------
```

FIG. 47 (cont.)

Table 15. (cont.)

```
B.BG1168     IQ---VQ.DY- I---------PI KSDNSDNTS. .---------- ---------- ---------I -E--------
B.JRFL       I--EVQ-EY-- --------V-PI ...-N-NTS. .---------- ---------S-D -----------I -E--------
B.SF162      I-N-MQ-EY-- --------V-PI ...-NDNTS. .-K-------- ---------- ---------- -E--------
C.ZM106      I---KRNES-- ---------P-- ...TNDNNSG E--------- AM-------- ---------- ----------
B.HXB2       I-G-VQ-EY-  F---------IPI D...NDTTS. .-K-TS----- ---------- ---------- -E-------- 240

C.CH0505T/F  PAGYAILKCN NKTFTGTGPC NNVSTVQCTH GIKPVVSTQL LLNGSLAEGE IIIRSENITN
A.Q168       ---F------ ---K DEK-N- ----K----- ---------- --------K- VM--------
A.Q842       ---F------ ---K DEE-N-I-- ----K----- ---------- --------K- VK---C----
B.BG1168     ---F------ --- D--K-S-K-T- ---------- ---R-----L.P VV-------EG VVL------F--
B.JRFL       ---F------ --- D-----N--- ----K----- ---R------ ---------E- VV------D-F--
B.SF162      ---F------ --- D--K-N-S-- ----T----- ---R------ ---------EG VV-------F-D
B.JRFL       ---------- --- ------N--- ----Y----- ---------- ---------- ---------L-D
C.ZM106      ---------- --- ------N--- ----T----- ---R------ ---------E- VV-----V-F-D
B.HXB2       ---F------ ---                                                               300

C.CH0505T/F  NVKTIIVHLN ESVKIECTRP NNKTRTSIRI ..GPGQAFYA TGQVIGDIRE AYCNINESKW
A.Q168       -A-N--L-QFK --P---N--- D--N------ ...-I----- ----Q----- -TV-G-E---
A.Q842       -A-------- ---Q--V NP ----N----- ---N--K--H- ..-------- ---DI----- -H--V-RTE-
B.BG1168     -A-------- ---Q--K DP -----E---- ---N--IK--HL ..---R-WH- -----I---- -F-TL-STN-
B.JRFL       -A-------- ---Q--K ----E--N--- ---N-K--H- ..---R----T ----EI---- -H---SRA--
B.SF162      -A-------- ---Q--K ----E--N--- ---N--K--T- ..---R----- ----DI---- -H---SGE--
C.ZM106      ---------- ----- --IH-T---- ---N--K---- ----T----- ----EI---K -S--E-----
B.HXB2       -A-------- ---Q-- T---E--N--- ---N--KR--- QR---R---VT I-K.--NM-Q -H---SRA--  360

C.CH0505T/F  NETLQRVSKK LKEYFF.HKN ITFQPSSGGD LEITTHSFNC GGEFFYCNTS SLFNRTYMAN
A.Q168       -KA--K-VEQ -RSS-E.N-T -I-AN----- ---------- ---------- G--DS-WNDT
A.Q842       -N--HQ-VEQ -RKH-.N-T -N-AN-T--- ---------- --------T N---S-WNHT
B.BG1168     TN--KQMVE- -R-Q-E.N-T -A-NQ-T--- F--VM-T--- --------T Q---SIWYNT
B.JRFL       -D--KQIVI- -R-Q-E.N-T -V-NH----- P---VM---- --------ST Q----S-WNN-
B.SF162      -N--KQIVT- -QAQ-G.N-T -V-KQ----- F---VM---- --------ST Q----S-WNNT
```

FIG. 47 (cont.)

Table 15. (cont.)

```
C.ZM106      -KA--E-G--  ----H--,N-T  --K-A-------  -----------  R----------  K----S---H-
B.HXB2       -N---KQIAS-  --R-Q-GNN-T  --I-KQ------  P---V------  -----------  ST--Q----S-WFNS  420

C.CH0505T/F  STDMANSTET  NSTRTITIHC   RIKQIINMWQ    EVGRAMYAPP   IAGNITCISN    ITGLLLTRDG
A.Q168       ........DSR  QENG----LP-  -----------  RT--Q-I----  -Q-A-R-V---  ----I------
A.Q842       A.....SMNS-  E-ND----ILP-  -----------  R---Q------  -R-V-R-E---  ----I------
B.BG1168     T.NSSWNNK--  W-NN-----LP-  -----------  Q---K-I----  -K-K-K-----  -----------
B.JRFL       T....EG-NN-  EGN.----LP-  -----------  -----K-----  -R-Q-R-S---  -----------
B.SF162      .....IGPN--  -TNG----LP-  -----R-----  -----------  -R-Q-R-S---  -----------
C.ZM106      A.....TSRN  ATNA----LP-  --R--------  -----V-----  -----V-----  -----------
B.HXB2       TWSTEG-NN-   EGSD----LP-  -----------  K---K------  -S-Q-R-S---  -----------  480

C.CH0505T/F  GK...NNTET  FRPGGGNMKD   NWRSELYKYK    VVEVKPLGVA   PTNARRRVVE    REKRAVGMGA
A.Q168       -NN.NSTN---  ----D-R----  -----------  ---KIE-----  ---K-------  ---G----I--
A.Q842       -NT.NSTR---  ----D-R----  -----------  ---KIE-----  ---L-------  --------I--
B.BG1168     -DT.N-G----I  ----D-R----  -----------  ---QIE-----  ---K-K-----Q  --------I--
B.JRFL       -IN.E-G----I  ----D------  -----------  ---KIE-----  ---K-K-----Q  --------L--
B.SF162      --EIS-T----I  ----D-R----  -----------  ---KIE-----  ---K-K-----Q  -------TL--
B.NGDT-D---  NGDT-D-----  ----D----N  -----------  ---I-------  ---E-K-----  --------I--
C.ZM106      -NS.N-ES---I  ----D-R----  -----------  ---KIE-----  ---K-K-----Q  --------I--
B.HXB2                                                                                        540

C.CH0505T/F  VFLGFLGAAG  STMGAASITL   TVQARQLLSG    IVQQQSNLLK   AIEAQQHMLK    LTVWGIKQLQ
A.Q168       ---I-------  -----------  -----------  -----------  -----L-R---  -----------
A.Q842       M----------  -----------  -----------  ------N---R  -----L-----  -----L-Q---
B.BG1168     -----------  -----------  -----------  ------N---R  -----------  -----L-Q---
B.JRFL       ----M------  -----------  ----L------  ------N---R  -----R---Q  -----L-Q---
B.SF162      M----------  -----------  ----L------  ------N---R  -----L---Q  -----L-Q---
C.ZM106      -L---------  -----------  --A----V---  -----------  -----L---Q  -----L-Q---
B.HXB2       L----------  ----M------  -----------  ------N---R  -----L---Q  -----L-Q---   600
```

FIG. 47 (cont.)

Table 15. (cont.)

```
           ARVLALERYL KDQQLLGMWG CSGKLICTTN VYWNSSWSNK TYGDIWDNMT WMQWEREISN
C.CH0505T/F
A.Q168     -----V---- ---------I ---------- ----P----- SQSE---E-- ---L----K-
A.Q842     -----V---- ---------I ---------- ----P----- SQNE------ ---L---DK-
B.BG1168   -----V---- ---------- ---------S ---P---A-- SQEE------ -------K-N
B.JRFL     -----V---- -------G-I ---------A ---P---A-- SQEE----L- ---------- 
B.SF162    -----V---- ---------I ---------A ---P---A-- SLDR---N-- ---E-----D
B.JRFL     T--------- ---------- ------R--- ---P---A-- SLDQ---N-- ---E-----D
B.SF162    ---------- ---------I ---------- ---A---F-- SLT------- ----------
C.ZM106    --I--V---- ---------- ---------A ---P---A-- SLEQ---NHT ---DK-V---
B.HXB2     ---------- ---------- ---------- ---------- ---------- ---E-D---N-  660

YTEIIYELLE ESQNQQEKNE QDLLALDKWN SLWNWFNITN WLWYIKIFIM IVGGLIGLRI
C.CH0505T/F
A.Q168     ---Q---T-I ---------- ------K-A- ------D-SK ------R--- ----------
A.Q842     ---Q---D-- ---------- ------K-A- N-----D-S- ---------- ----------
B.BG1168   ---SV--T-- -----Q---- --E-E--K-A ------D--K ------R--- ----------
B.JRFL     ---SE--T-I ---------- --E-E--K-A ------D--K ---------- ----------
B.SF162    ---NL--T-I ---------- --E-E--K-A ------D-SK ---------- ----------
C.ZM106    ---NT--R-- ---D--S--- K-----S-K- N--T---D-S ---------V ----------
B.HXB2     ---SL-HS-I ---------- --E-E--K-A ---------- ------L--- ------V---  720

IFAVLSLVNR VRQGYSPLSL QTLIPSPRGP DRPGGIEEEG GEQDRNRSTR LVSGFLALVW
C.CH0505T/F
A.Q168     V-----V--- ---------- ---L-A---- ----D----- ----G-G--RQ ---N--ST-I
A.Q842     V-----VI-- ---------- --HT-N--L- -------ER- ------K--I- -------A--
B.BG1168   V--I------ ---------F ---RF-A--- ----E----- --GR---I-- -------P-I
B.JRFL     V-T---I--- ---------F ---L-A---- ----E----- ---R--D--G ---N-----I
B.SF162    V-T---I--- ---------- ---RF-A--- ----E----- ---R--D-SP ---H-L---I
C.ZM106    ---I--I--- ---------- ---TQ--G-- ----L-R--- ---R--D--I ---N---T-A
B.HXB2     V-----I--- ---------F ---HL-T--- ----E----- ---R--D--I- ---N-S---I  780

DDLRSLCLFI YHRLRDFILI AARAGELLGR SSLKGLRRGW EALKYLGSLV QYWGLELKRS
C.CH0505T/F
```

FIG. 47 (cont.)

Table 15. (cont.)

```
A.Q168        ----N------S  ------------  -----L------  ------IV----  ------------  ------------  -I----WN-L  ----IQ----N-
A.Q842        ------------  ------------  ------------  V---TV----H   ------------  ------------  -G----N-L S----R---RI-
B.BG1168      ------------  ------------  ------------  V---IV------  ------------  ------------  ------WWN-L ----SQ----N-
B.JRFL        V-----------  ------------  -----LL--T    VT--IV------  ------------  ------------  -V----WWN-L ----SQ----N-
B.SF162       ------------  ------------  ------------  ----IV------  ------------  ------------  ------W-N-L ----IQ----N-
B.ZM106       ------------  ------------  ------------  ---VV-----H   ------R---QK- ------------  ------C-----
C.ZM106       ------------  ------------  -----LL-----  VT--IV------  ------------  ------------  ------WWN-L ----SQ----N-  840
B.HXB2

C.CH0505T/F   AISLLDTLAI   AVGEGTDRIL    EFVLGICRAI   RNIPTRIRQG    FETALL                         (SEQ ID NO: 15)
A.Q168        ----N-T---   ---A------AI  --IIQRAIT-V  L--------                                    (SEQ ID NO: 16)
A.Q842        --TN----I--  VIAGW----VI  --IGQRL---F   L---R----                                    (SEQ ID NO: 17)
B.BG1168      -V--N-T---   V--A------I   -ALQR------  LH-------                                    (SEQ ID NO: 18)
B.JRFL        -V----NAT--  ---A------I   -ALQRTY----  LH-------                                    (SEQ ID NO: 19)
B.SF162       -V--F-AI--   ---A------I   -VAQR-G---F  L-R------                                    (SEQ ID NO: 20)
B.ZM106       ------SI-M   ---A------I   -L--QR----G  YH---R---                                    (SEQ ID NO: 21)
C.ZM106       -V----NAT--  ---A------VI  -V-Q-A-----  ---H---R-    886                             (SEQ ID NO: 22)
B.HXB2
```

ANTIBODY EVOLUTION IMMUNOGENS

This application is the U.S. National Phase of International Application No. PCT/US2013/000210, filed Sep. 12, 2013, which designated the U.S. and claims priority from U.S. Provisional Application Nos. 61/700,252, filed Sep. 12, 2012, 61/708,466, filed Oct. 1, 2012 and 61/764,421, filed Feb. 13, 2013, the entire contents of each of which are incorporated herein by reference.

This invention was made with government support under Grants AI1067854 and AI100645 awarded by the National Institutes of Health. The government has certain rights in the invention.

The instant application contains a Sequence Listing which has been submitted electronically in ASCII format and is hereby incorporated by reference in its entirety. Said ASCII copy, created on Mar. 11, 2015, is named 1579-1905 SL.txt and is 4,608 KB in size.

TECHNICAL FIELD

The present invention relates, in general, to HIV-1 and, in particular, to broadly neutralizing HIV-1 antibodies, and to HIV-1 immunogens and to methods of using such immunogens to induce the production of broadly neutralizing HIV-1 antibodies in a subject (e.g., a human).

BACKGROUND

Induction of HIV-1 envelope (Env) broadly neutralizing antibodies (BnAbs) is a key goal of HIV-1 vaccine development. BnAbs can target conserved regions that include conformational glycans, the gp41 membrane proximal region, the V1/V2 region, glycans-associated C3/V3 on gp120, and the CD4 binding site (CD4bs) (Walker et al, Science 326:285-289 (2009), Walker et al, Nature 477:466-470 (2011), Burton et al, Science 337:183-186 (2012), Kwong and Mascola, Immunity 37:412-425 (2012), Wu et al, Science 329:856-861 (2010), Wu et al, Science 333:1593-1602 (2011), Zhou et al, Science 329:811-817 (2010), Sattentau and McMichael, F1000 Biol. Rep. 2:60 (2010), Stamatotos, Curr. Opin. Immunol. 24:316-323 (2012)). Most mature BnAbs have one or more unusual features (long heavy chain third complementarity determining regions [HCDR3s], polyreactivity for non-HIV-1 antigens, and high levels of somatic mutation) suggesting substantial barriers to their elicitation (Kwong and Mascola, Immunity 37:412-425 (2012), Haynes et al, Science 308:1906-1908 (2005), Haynes et al, Nat. Biotechnol. 30:423-433 (2012), Mouquet and Nussenzweig, Cell Mol. Life Sci. 69:1435-1445 (2012), Scheid et al, Nature 458:636-640 (2009)). In particular, CD4bs BnAbs have extremely high levels of somatic mutation suggesting complex or prolonged maturation pathways (Kwong and Mascola, Immunity 37:412-425 (2012), Wu et al, Science 329:856-861 (2010), Wu et al, Science 333:1593-1602 (2011), Zhou et al, Science 329:811-817 (2010)). Moreover, it has been difficult to find Envs that bind with high affinity to BnAb germline or unmutated common ancestors (UCAs), a trait that would be desirable for candidate immunogens for induction of BnAbs (Zhou et al, Science 329:811-817 (2010), Chen et al, AIDS Res. Human Retrovirol. 23:11 (2008), Dimitrol, MAbs 2:347-356 (2010), Ma et al, PLoS Pathog. 7:e1002200 (2001), Pancera et al, J. Virol. 84:8098-8110 (2010), Xiao et al, Biochem. Biophys. Res. Commun. 390:404-409 (2009)). Whereas it has been found that Envs bind to UCAs of BnAbs targeting gp41 membrane proximal region (Ma et al, PLoS Pathog. 7:e1002200 (2001), Alam et al, J. Virol. 85:11725-11731 (2011)), and to UCAs of some V1/V2 BnAb (Bonsignori et al, J. Virol. 85:9998-10009 (2011)), to date, heterologous Envs have not been identified that bind the UCAs of CD4bs BnAb lineages (Zhou et al, Science 329:811-817 (2010), Xiao et al, Biochem. Biophys. Res. Commun. 390:404-409 (2009), Mouquet et al, Nature 467:591-595 (2010), Scheid et al, Science 333:1633-1637 (2011), Hoot et al, PLoS Pathog. 9:e1003106 (2013)), although Envs that bind CD4bs BnAb UCAs should exist (Hoot et al, PLoS Pathog. 9:e1003106 (2013)).

Eighty percent of heterosexual HIV-1 infections are established by one transmitted/founder (T/F) virus (Keele et al, Proc. Natl. Acad. Sci. USA 105:7552-7557 (2008)). The initial neutralizing antibody response to this virus arises approximately 3 months after transmission and is strain-specific (Richman et al, Proc. Natl. Acad. Sci. USA 100:4144-4149 (2003), Corti et al, PLoS One 5:e8805 (2010)). This antibody response to the T/F virus drives viral escape, such that virus mutants become resistant to neutralization by autologous plasma (Richman et al, Proc. Natl. Acad. Sci. USA 100:4144-4149 (2003), Corti et al, PLoS One 5:e8805 (2010)). This antibody-virus race leads to poor or restricted specificities of neutralizing antibodies in ~80% of patients; however in ~20% of patients, evolved variants of the T/F virus induce antibodies with considerable neutralization breadth, e.g. BnAbs (Walker et al, Nature 477:466-470 (2011), Bonsignori et al, J. Virol. 85:9998-10009 (2011), Corti et al, PLos One 5:e8805 (2010), Gray et al, J. Virol. 85:4828-4840 (2011), Klein et al, J. Exp. Med. 209:1469-1479 (2012), Lynch et al, J. Virol. 86:7588-7595 (2012), Moore et al, Curr. Opin. HIV AIDS 4:358-363 (2009), Moore et al, J. Virol. 85:3128-3141 (2011), Tomaras et al, J. Virol. 85:11502-11519 (2011)).

There are a number of potential molecular routes by which antibodies to HIV-1 may evolve and, indeed, types of antibodies with different neutralizing specificities may follow different routes (Wu et al, Science 333:1593-1602 (2011), Haynes et al, Nat. Biotechnol. 30:423-433 (2012), Dimitrol, MAbs 2:347-356 (2010), Liao et al, J. Exp. Med. 208:2237-2249 (2011)). Because the initial autologous neutralizing antibody response is specific for the T/F virus (Moore et al, Curr. Opin. HIV AIDS 4:358-363 (2009)), some T/F Envs might be predisposed to binding the germline or unmutated common ancestor (UCA) of the observed BnAb in those rare patients that make BnAbs. Thus, although neutralizing breadth generally is not observed until chronic infection, a precise understanding of the interplay between virus evolution and maturing BnAb lineages in early infection may provide insight into events that ultimately lead to BnAb development. BnAbs studied to date have only been isolated from individuals who were sampled during chronic infection (Walker et al, Science 326:285-289 (2009), Burton et al, Science 337:183-186 (2012), Kwong and Mascola, Immunity 37:412-425 (2012), Wu et al, Science 329:856-861 (2010), Wu et al, Science 333:1593-1602 (2011), Zhou et al, Science 329:811-817 (2010), Bonsignori et al, J. Virol. 85:9998-10009 (2011), Corti et al, PLoS One 5:e8805 (2010), Klein et al, J. Exp. Med. 209:1469-1479 (2012)). Thus, the evolutionary trajectories of virus and antibody from the time of virus transmission through the development of broad neutralization remain unknown.

Vaccine strategies have been proposed that begin by targeting unmutated s common ancestors (UCAs), the putative naïve B cell receptors of BnAbs, with relevant Env immunogens to trigger antibody lineages with potential ultimately to develop breadth (Wu et al, Science 333:1593-

1602 (2011), Haynes et al, Nat. Biotechnol. 30:423-433 (2012), Scheid et al, Nature 458:636-640 (2009), Chen et al, AIDS Res. Human Retrovirol. 23:11 (2008), Dimitrol, MAbs 2:347-356 (2010), Ma et al, PLoS Pathog. 7:e1002200 (2001), Xiao et al, Biochem. Biophys. Res. Commun. 390:404-409 (2009), Alam et al, J. Virol. 85:11725-11731 (2011), Mouquet et at, Nature 467:591-595 (2010)). This would be followed by vaccination with Envs specifically selected to stimulate somatic mutation pathways that give rise to BnAbs. Both aspects of this strategy have proved challenging due to lack of knowledge of specific Envs capable of interacting with UCAs and early intermediate (I) antibodies of BnAbs.

The present invention results, at least in part, from studies that resulted in the isolation of the CH103 CD4bs BnAb clonal lineage from an African patient, CH505, who was followed from acute HIV-1 infection through BnAb development. The studies show that the CH103 BnAb lineage is less mutated than most other CD4 binding site BnAbs, and may be first detectable by as early as 14 weeks after HIV-1 infection. Early autologous neutralization by antibodies in this lineage triggered virus escape, but rapid and extensive Env evolution in and near the epitope region preceded the acquisition of plasma antibody neutralization breadth defined as neutralization of heterologous viruses. Analysis of the cocrystal structure of the CH103 Fab and a gp120-core demonstrated a novel loop binding mode of antibody neutralization.

SUMMARY OF THE INVENTION

In general, the present invention relates to HIV-1 and to broadly neutralizing HIV-1 antibodies. More specifically, the invention relates to HIV-1 immunogens and compositions comprising same. The invention further relates to methods of inducing the production of broadly neutralizing HIV-1 antibodies in a subject (e.g., a human) and to compounds and compositions suitable for use in such methods.

Objects and advantages of the present invention will be clear from the description that follows.

BRIEF DESCRIPTION OF THE DRAWINGS

FIG. 1A, Shown are HIV-1 viral RNA copies and reactivity of longitudinal plasmas samples with HIV1-1 YU2 core gp120, RSC3 and negative control ΔRSC3 proteins. FIG. 1B, PBMCs from week 136 was used for sorting CD19$^+$, CD20+, IgG$^+$, RSC3$^+$ and RSC3Δ37II$^-$ memory B cells (0.198%). Cells indicated as orange, blue and green dots yielded mAbs CH103, CH104 and CH106, as identified by index sorting. FIG. 1C, Shown are HIV-1 neutralization potency and breadth of CH103 antibody. A neighbor joining phylogenetic tree created by neighbor joining method (NJ tree PHYLIP package software) of 196 HIV-1 Envs representing major circulating clades is colored according to IC50 of neutralized virus by CH103. FIG. 1D, Cross competition of CH103 binding to YU2 gp120 by the indicated HIV-1 antibodies, and soluble CD4-Ig was determined in ELISA.

FIG. 2C, CH103 lineage with the inferred intermediates (circles, I1-4, I7 and I8), and percentage mutated $V_H$ sites and timing (blue), indicated. FIG. 2D, Binding affinity (Kd, nM) of antibodies to autologous CH505 (left box) and heterologous B.63521 were measured by SPR (right box).

FIG. 3A, Overall structure of complex with gp120 polypeptide depicted in red ribbon and CH103 shown as a molecular surface (heavy chain in green and light chain in blue). FIG. 3B, Superposition of OD bound by CH103 (red) and core gp120 bound by CH103 (gray) with polypeptide shown in ribbon representation. FIG. 3C, CH103 epitope (green) on OD (red) with the initial CD4-binding site superposed (yellow boundaries) in surface representation. FIG. 3D, Sequence alignment of outer domains of the crystallized gp120 shown on the first line and diverse HIV-1 Envs recognized by CH103 (SEQ ID NOS 23-28, respectively, in order of appearance). Secondary structure elements are labeled above the alignment with gray dashed lines indicating disordered regions. Symbols in yellow or green denote gp120 OD contacts for CD4 and CH103, respectively, with open circles representing main-chain contacts, open circles with rays representing side-chain contact, and filled circles representing both main-chain and side-chain contacts.

FIG. 4A, Overall structure of complex with variable domains of CH103 depicted in ribbon representation and gp120 shown as a molecular surface. The color scheme is the same as in FIG. 3A. FIG. 4B, CH103 paratope surface displayed on top of an underlying polypeptide ribbon. The surface is colored and labeled by contributing antibody components. FIG. 4C, CH103 paratope surface colored by maturation states of the underlying residues. Unmutated residues are colored magenta while affinity matured residues are colored green and light blue for heavy and light chains respectively. FIG. 4D, Sequence alignment of heavy (SEQ ID NOS 29-42, respectively, in order of appearance) and light (SEQ ID NOS 43-47, respectively, in order of appearance) chains of CH103 clonal lineage members. Framework and CDR residues are labeled, as are residues that interact with the gp120 (open circle, main chain interaction; open circle with rays, side chain interactions; filled circle, both main chain and side chain interactions). The unmutated paratope residues are highlighted in magenta and the maturation-gained paratope residues are highlighted in green for heavy chain and blue for light chain.

FIG. 6A, Phylogenetic CH103 clonal lineage tree showing the IC50 (µg/ml) of neutralization of either the autologous T/F (C.CH505), heterologous tier clades A (A.Q842) and B (B.BG1168) viruses as indicated. FIG. 6B, Interplay between evolving virus and developing clonal lineage mapped on to models of CH103-developmental variants and contemporaneous virus. The outer domain of HIV gp120 is depicted in worm representation, with worm thickness and color (white to red) mapping the degree of per-site sequence diversity at each time point. Models of antibody intermediates are shown in cartoon diagram with somatic mutations at each time point highlighted in spheres and colored red for mutations carried over from I8 to mature antibody, cyan for mutations carried over from I4 to mature antibody, green for mutations carried over from I3 to mature antibody, blue for mutations carried over from I2 to mature antibody, orange for mutations carried over from I1 to mature antibody, magenta for CH103 mutations from I1. Transient mutations that did not carry all the way to mature antibody are colored in deep olive. The antibody (paratope) residues are shown in surface representation and colored by their chemical types as in FIG. 5.

FIGS. 7A and 7B. Hamming distance frequency distributions of sequences at (FIG. 7A) week 4 and (FIG. 7B) week 14. A model of the best fit Poisson distribution is shown as a red line. Analysis of the sequence diversity in the first available sample (FIG. 7A) from subject CH505 using the Poisson Fitter tool (ref below) indicates that the sequences were a consistent with a star phylogeny and that the mutations were accumulating according to a Poisson distribution (goodness of fit p=0.11). This is consistent with a single founder virus establishing the infection, with random accumulation of mutations prior to selection. The lambda parameter was 1.325, and assuming the mutation rate of 2.16 10-05, the estimated time from the most recent common ancestor was 22 days (95% CI, 18-27). Given that the outer bound of this confidence interval is 27 days, it is highly like this sample was taken within 4 weeks of infection, thus this sampling time is called "week 4" as a conservative estimate. This timing estimate is further supported by Feibig staging at time of enrollment. By week 14 (FIG. 7B), the tree was no longer consistent with a star phylogeny or a Poisson distribution (p<<10-10), indicating selection was well underway. Of note, although the mutation data at week 4 (FIG. 7A) is statistically consistent with a Poisson distribution, the observed number of pairwise sequence identities was somewhat reduced relative to expectation, and the observed number of Hamming distances of 1 and 2 are slightly more than expected. This is of interest as this shift is the a result of a single mutation in loop D, in a CH103 contact residue (N279K)—so although the deviation from the Poisson was not significant, given its location it is possible that the site is a very early indicator of selection. (Giorgi et al, BMC Bioinformatics October 25; 11:532 (2010), PMID: 20973976 www.hiv.lanl.gov/content/sequence/POISSON_FITTER/poisson_fitter.html FIG. 8. Binding of plasma antibodies of CH505 patient over time to autologous transmitted/founder (T/F) and heterologous HIV-1 Env proteins. Plasma samples were longitudinally collected from HIV-1 patient CH505 starting from time of infection (in x axis) and tested for neutralization activity against the autologous transmitted/founder (T/F) virus and heterologous HIV-1 Env pseudoviruses including subtype B (B) SF162, JRFL and BG1168) and subtype A in TZM-bl cell-based neutralization assays. Results were expressed as IC50 (reciprocal plasma dilution) (in y axis).

FIGS. 9A and 9B. Reactivity of antibodies in CH103 clonal lineage to HIV-1 Env resurfaced core3 (RSC3) and RSC3 mutant. Antibodies in CH103 clonal lineage were tested in dose range from 100 µg to 0.0005 µg/ml for binding to (FIG. 9A) HIV-1 Env RSC) and (FIG. 9B) RSC3 with P363N and D3711 mutations in ELISA. Results are expressed as EC50 (µg/ml) and are indicated next to the individual antibodies. NB=no detectable binding.

FIGS. 10A and 10B. SDS-PAGE analysis of recombinant HIV-1 Env gp140 and gp120 proteins*. HIV-1 Env gp120 and gp140 proteins were analyzed on SDS-PAG under reducing condition (FIG. 10A) and gp140 proteins were analyzed on blue negative PAGE for (FIG. 10B). Individual HIV-1 Env proteins are identified on the tope of gels. FIG. 10A, The HIV-1 gp120 and gp140 used in the study had no degradation under reducing condition in SDS-PAGE. FIG. 10B, Most heterologous HIV-1 Env gp140 Envs and all autologous CH505 gp140 Envs migrated predominantly as trimers and also contain dimer and monomer forms.

FIGS. 11A-11D. Polyreactivity analysis of CH103 clonal lineage antibodies by HEp-2 staining, ANA assays and protein array microchip analysis. Reactivity of antibodies in CH103 clonal lineage was assayed by indirect immunofluorescence staining (FIG. 11A) and by ANA assays (FIG. 11B). Pictures at magnification ×200 of immunofluorescence staining for individual antibodies are presented next to the antibody ID. Results of the reactivity of individual antibodies with panel of autoantigens assayed by ANA is indicated (FIG. 11B). The intermediate antibody (I1) and CH106 were identified as reactive with HEp-2 cells and then selected for further testing for reactivity with human host cellular antigens (FIGS. 11C and 11D) using Invitrogen ProtoArrays™. It was found that I1 (FIG. 11C) and CH106 ((FIG. 11D) exhibit specific autoreactivity and robust polyreactivity. Bound antibody was determined by immunofluorescence and relative fluorescence intensities for 9,400 recombinant human proteins in the 151K array (y-axis) is plotted against (x-axis) the homologous intensities in IA1 (FIG. 11C) and CH106 (FIG. 11D) arrays. All proteins are printed in duplicate on each array and each data point represents one fluorescence measurement. The diagonals in each graph represent equal fluorescence intensities (equivalent binding) by the I1, CH106 and 151K control Ab. Self-antigens bound by the I1 and CH106 are identified by high fluorescence intensity versus 151K and are indicated by circles. Polyreactivity is indicated by significant and general skewing from the diagonal. Autoantigens identified: BHMT2 (betaine-homocysteine methyltransferase 2); CENP-R (centromere protein R) [151K]; eEF-2K (eukaryotic elongation factor-2 kinase); UBE3A (ubiquitin-protein ligase E3A) [IA1 and CH106]; TGM2 (transglutaminase 2) [CH106]; NFKBIA (nuclear factor of kappa light polypeptide gene enhancer in B-cells inhibitor, alpha); FAM184A (family with sequence similarity 184, member A) [I1].

FIGS. 12A and 12B. Crystal packing of the CH103-gp120 complex in P21 space group. FIG. 12A, A view of the crystal lattice. The two complexes in each asymmetric unit are marked with red and blue dashed lines and are shown in cartoon diagrams with gp120 in red and salmon. CH103 heavy chain in green and palegreen, and CH103 light chain in light blue and cyan. FIG. 12B, A close-up view of the lattice between two neighboring complexes. When extended core gp120 of clade C ZM176.66 from the VRC01 complex is superposed with its ordered corresponding portions in the CH103 complex, the inner domain shown in magenta clashes with the neighboring complex, indicating inner domain of gp120 is not present in the CH103-gp120 crystal due to proteolytic degradation during crystal growth.

FIG. 13. Pixel map and phylogenetic tree of HIV evolution over time in CH505. The pixel tool (www.hiv.lanl.gov/content/sequence/pixel/pixel.html) was used to illustrate the amino changes in the V1 to V5 region of the envelope; focus was on this region as it most critical CD4bs antibody susceptibility, and includes of all known CD4 binding contacts, which are indicated as black tic marks along the top of the figure. Blue tic marks indicated CH103 contact residues, and the horizontal blue line indicates that part of gp120 that was used for the CH103 crystal structure (although the contact surface is mostly there, still quite a bit is missing that is important for CD4 and VRC01, which is why we use CD4 contacts to help define bits that may be important for CH103 binding in those missing regions). Each row is a sequences, and they are ordered according to the phylogeny. Red bits indicate amino acid change relative to the TF virus, and black bits indicate either an insertion or deletion. The phylogenetic tree on the right was made with PhyML v2 [1] and the JTT substitution model [2] from the translated Env sequences. The tree was configured as a ladder and the T/F virus was reconstructed from the first time point sequences obtained at week 4 after transmission. Colors indicated the estimated number of weeks from infection. The tree was rendered with APE v3.0-6 [3] and both used R v2.15.1 [4]. The arrow indicates the week 30-53 selective bottleneck. (Guindon et al, Syst. Biol. 52:696-704 (2003), Jones et al, Comput Applic Biosci 8: 275-282 (1992), Paradis et al, Bioinformatics 20:289-290 (2004), R Core Team. 2012. R: A language and environment for statistical computing. R Foundation for Statistical Computing, Vienna, Austria. ISBN 3-900051-07-0, URL www.R-project.org/.)

FIG. 14. Entropy map illustrating the per site diversity within each time point sampled in CH505. Full gp160 is shown, and CD4 and CH103 contact residues are highlighted. This figure shows the Shannon entropy of each position in the alignment, where the observed frequency of all in a position characters is considered, and a gap is treated as a character (Korber J Virol. 1994; 68(11):7467-81). This provides a map of regional within-time point diversity spanning Env, and illustrates where mutations are concentrated and the relative diversity of key regions over time.

FIGS. 15A and 15B. A comparison of the speed of viral sequence evolution in CH505 in regions relevant to the CH103 epitope to other subjects. FIG. 15A, The distribution of sequence distances expressed as the percentage of amino acids that are different between two sequences, resulting from in a pairwise comparison of all sequences sampled in a given time point. These are all homogeneous infection cases, so in acute infection there is very little mutation in the CH103 relevant regions, or elsewhere in the virus (left hand panels). By 24 weeks after enrollment (week 30 from infection in CH505, labeled month 6 here as it is approximate), extensive mutations have begun to accrue, focused in CH103 relevant regions (top middle panel), but not in other regions of Env (bottom middle panel). CH103 has the highest ranked diversity among 15 subject sampled in this time frame (p=0.067), indicating a focused selective pressure began unusually early in this subject. By 1 year (month 12 indicates samples taken between 10-14 months from enrollment), this region has begun to evolve in many individuals, possibly due to autologous NAb responses that come up later in infection. FIG. 15B, Phylogenetic trees based on CH103 relevant regions. In this view, the extensive evolution away from the T/F virus by month 6, shown in gold, is particularly striking. The distance between sequences sampled in CH505 at month 6 and the T/F ancestral state were much greater than the sequences in the second most variable individual 704010042 (Wilcoxon rank sum, p=0.0003: CH505, median=0.064, range=0.019-0.13, N=25, and 704010042, median=0.027, range=0.009-0.056, N=26).

FIGS. 17A and 17B. Amino acid (FIG. 17A) (SEQ ID NOS 48-445, respectively, in order of appearance) and nucleic acid (FIG. 17B) (SEQ ID NOS 446-843, respectively, in order of appearance) sequences. 703010505.TF is the transmitted/founder sequence and "W and number" indicates the week after transmission FIG. 18. Antibody-virus co-evolution in acutely infected patients followed to BnAb induction.

FIGS. 19A-19D. Multivalent vaccine sequences. CH505 Env sequences (FIGS. 19A and 19B) (FIGS. 19A and 19B each disclose SEQ ID NOS 844-860, respectively, in order of appearance), and CH505_D8gp120 sequences (FIG. 19C) (SEQ ID NOS 861-878, respectively, in order of appearance) and corresponding cleavage site mutations (FIG. 19D) (SEQ ID NOS 879-896, respectively, in order of appearance) (underlined).

FIG. 20. The HIV-1 arms race: isolation of broad neutralizing antibodies from chronically infected patient CH0505 followed from time of transmission.

FIG. 26. HIV-1 vaccine design. FIG. 26 discloses SEQ ID NOS 897-898, respectively, in order of appearance.

FIG. 27 discloses SEQ ID NOS 899-908, respectively, in order of appearance.

FIG. 28. Alignment of CH505 Env gp120 with RSC3. FIG. 28 discloses SEQ ID NOS 909-910, respectively, in order of appearance.

FIG. 29. Design for CH505 outer domain immunogen. FIG. 29 discloses SEQ ID NO: 911, residues 1-65 of SEQ ID NO: 911, SEQ ID NO: 912, residues 1-65 of SEQ ID NO: 912 and SEQ ID NO. 913, respectively, in order of appearance.

FIG. 30. Plasma binding ratio of RSC3 to RSC3delta371 proteins induced by CH505 Env variants alone or sequentially administered to BALB/c mice.

FIG. 31 shows plasma neutralization activity developed over time of in patient CH505 against the autologous transmitted/funder (T/F) and heterologous viruses. *EC50 values for positive control antibody 2F5 are presented as ug/ml. MuLV=murine leukemia virus as negative control. FIG. 31 corresponds to, and is referred to, as Table 1 throughout the specification.

FIG. 32 shows V(D)J rearrangement of the matured, and reverted unmutated ancestor and intermediate antibodies in CH103 clonal lineage. [1]The HCDR3 and LCDR3 lengths of the CH103 lineage are similar to the median of HCDR3 and LCDR3 lengths of unrelated antibodies in pyrosequencing database or Genbank. Using the same 454 pyrosequencing dataset derived from three HIV infected subjects unrelated to the CH505 patient as the source of comparison, we find that the CH103 CDRH3 length of 45 nucleotides (15 aa) is the median value. The interquartile range is 39-54 nucleotides (13-18 aa). 9% of all heavy chains in this database have HCDR3 length=45 nucleotides, this is the second most-frequent length, after 42 nucleotides. We used human L\lambda rearrangements from Genbank to compare the light chain. The CH103 light chain CDR3 is 30 nucleotides (10 aa) long. The median among Genbank human lambda chains is 33 nucleotides (11 aa). 24% of all human lambda chains have HCDR3 length=30 nt, second-most frequent after 33nt. FIG. 32 corresponds to, and is referred to, as Table 2 throughout the specification.

FIG. 33 shows a comparison of neutralization activity of CH103, and other CD4bs mAbs against 25 clade A Env-pseudoviruses. [a]Values <1µg/ml are indicated in single outlined cells and values 1-50 µg/ml are in double outlined cells. [b]Geometric means were calculated for neutralization sensitive viruses with an $IC_{50}$ or $IC_{80}$ value <50µg/ml. *Results of 118 isolates summarized in Tables 3a, b and c are representatives of total of 196 isolates tested. FIG. 33 corresponds to, and is referred to, as Table 3a throughout the specification.

FIG. 34 shows a comparison of neutralization activity of CH103, and other CD4bs mAbs against 39 clade B Env-pseudoviruses. [a]Values <1µg/ml are indicated in single outlined cells and values 1-50 µg/ml are in double outlined cells. [b]Geometric means were calculated for neutralization sensitive viruses with an $IC_{50}$ or $IC_{80}$ value <50µg/ml. FIG. 34 corresponds to, and is referred to, as Table 3b throughout the specification.

FIG. 35 shows a comparison of neutralization activity of CH103, and other CD4bs mAbs against 54 clade C Env-pseudoviruses. [a]Values <1µg/ml are indicated in single outlined cells and values 1-50 µg/ml are in double outlined cells. [b]Geometric means were calculated for neutralization sensitive viruses with an $IC_{50}$ or $IC_{80}$ value <50µg/ml. FIG. 35 corresponds to, and is referred to, as Table 3c throughout the specification.

FIG. 36 shows binding of antibodies in CH103 clonal lineage to heterologous HIV-1 Env proteins. NB=No dateable binding. FIG. 36 corresponds to, and is referred to, as Table 4 throughout the specification.

FIG. 37 shows affinity and kinetics of CH103 UCAs binding to autologous T/F CH505 gp140. SPR binding rate constants and dissociation constant ($K_d$) was measured with each antibody captured on an anti-IgG (Fc specific) antibody surface and CH505 gp140 was injected in solution at concentrations ranging from 2 to 100 ug/mL and as described in the online Methods section. Data is representative of at least two independent measurements. [b]Amino acid sequences encoded by $V_H DJ_H$ of CH103UCAs-2, 4-6 are the same amino acid as shown in the alignment shown. DNA sequence alignment of $V_H DJ_H$ CH103 UCAs: (SEQ. ID NOS 1-6, respectively in order of appearance). Amino acid sequence of $V_H DJ_H$ CH103 UCAs: (SEQ ID NOS 7-12, respectively, in order of appearance). FIG. 37 corresponds to, and is referred to, as Table 5 throughout the specification.

FIG. 38 shows reactivity of autologous Envs with antibodies in CH103 clonal lineage in ELISA. *Env proteins outlined had 2-fold or greater loss of binding affinity to antibodies in CH103 clonal lineage compared with the binding of transmitted/founder (T/F) Env to the same antibodies. NB=No detectable binding. FIG. 38 corresponds to, and is referred to, as Table 6 throughout the specification.

FIG. 39 shows $V_H DJ_H$ sequences 2 genes (IZ95W and 02IV4) very similar to the CH103 VDJ genes, possible clonal members, identified by 454 sequencing and alignment with their UCA. $V_H DJ_H$ genes of IZ95W and 02IV4 were produced as recombinant antibodies complemented with $V_L J_L$ genes of UCA and tested for binding to the autologous CH505 T/F Env and heterologous HIV-1 Envs in ELISA assays. MAb IZ95W bound CH505 T/F gp140 with end point titer of 11.1 ug/ml, but did not BIND with heterologous Envs, 6321, 9021, 1086C and 427299. FIG. 39 corresponds to, and is referred to, as Table 7 throughout the specification.

FIG. 40 shows crystallographic data collection and refinement statistics. * Values in parentheses are for highest-resolution shell. The antigen-binding fragment (Fab) of CH103 was screened for crystallization, either by itself or in complex with various strains of HIV-1 expressed with an extended gp120 core[1], which had been deglycosylated to protein-proximal N-acetyl glucosamines[2]. Crystals of Fab CH103 by itself diffracted to 1.6-Å resolution, and the Fab CH103 structure was solved by molecular replacement and refined to $R_{crystal}/R_{free}$ of 17.9%/20.1%. [1]Kwon YD, et al. (2012) Unliganded HIV-1 gp120 core structures assume the CD4-bound conformation with regulation by quaternary interactions and variable loops. Proc Natl Acad Sci USA 109(15):5663-5668. [2]Kwong PD, et al. (1999) Probability analysis of variational crystallization and its application to gp120, the exterior envelope glycoprotein of type 1 human immunodeficiency virus (HIV-1). J Biol Chem 274(7):4115-4123. FIG. 40 corresponds to, and is referred to, as Table 8 throughout the specification.

FIG. 41 shows a comparison of interactions between HIV-1 gp120 and CD4, CH103 and other CD4-binding site antibodies. *:Residues with interacting surface area less than 2.0 Å are not listed. Table 9 discloses the residues at positions 122-127, 278-283, 364-373, 424-432, 458-463 and 471-475 as SEQ ID NOS 914-919, respectively. FIG. 41 corresponds to, and is referred to, as Table 9 throughout the specification.

FIG. 42 shows the interface between antibody CH103 and ZM176.66 gp120. Supplementary Table 10a shows the total buried surface areas across the interface of CH103 and HIV-1 gp120. Table 10b, Residue-by-residue buried surface area of gp120 residues that interact with CH103. * Bond type: H: Hydrogen, S: Salt bridge. Detailed gp120:CH103 interface data was calculated on the EBI PISA server (www.ebi.ac.uk/msdsrv/prot_int/cgi-bin/piserver). Table 10b discloses the residues at positions 364-371 and 457-463 as SEQ ID NOS 920-921, respectively. Table 10c. Residue-by-residue buried surface areas of the CH103 paratope residues. * Bond type: Hydrogen, D: Disulphide bond, S: Salt bridge, C: Covalent link.Detailed gp120:CH103 interface data was calculated on the EBI PISA server (www.ebi.ac.uk/msdsrv/prot_/cgi-bin/piserver). Table 10c discloses the residues at positions 97-100B, 50-53 and 65-68 as SEQ ID NOS 922-924, respectively. FIG. 42 corresponds to, and is referred to, as Supplementary Table 10a, Table 10b, and Table 10c throughout the specification.

FIG. 43 shows hydrogen bonds and salt bridges between CH103 and ZM176.66 gp120. FIG. 43 corresponds to, and is referred to as Table 11 throughout the specification.

FIG. 44 shows residue-by-residue specification of unmutated versus mutated residues on antibody CH103. Table 12 discloses residues 26-27C as SEQ ID NO: 925. To determine the frequency of germline antibodies that could potentially serve as unmutated common ancestors of a lineage line CH103, we have interrogated a combined dataset of 454 pyrosequences of three HIV infected subjects unrelated to the CH505 patient. Gene segment frequencies in this dataset demonstrate that the frequency of the VH4-59 gene is 4.2%, the JH4 is 49.7% and the frequency of HCDR3 length of the CH103 VH length (a 15mer) is 8.9%.

Figure 4:
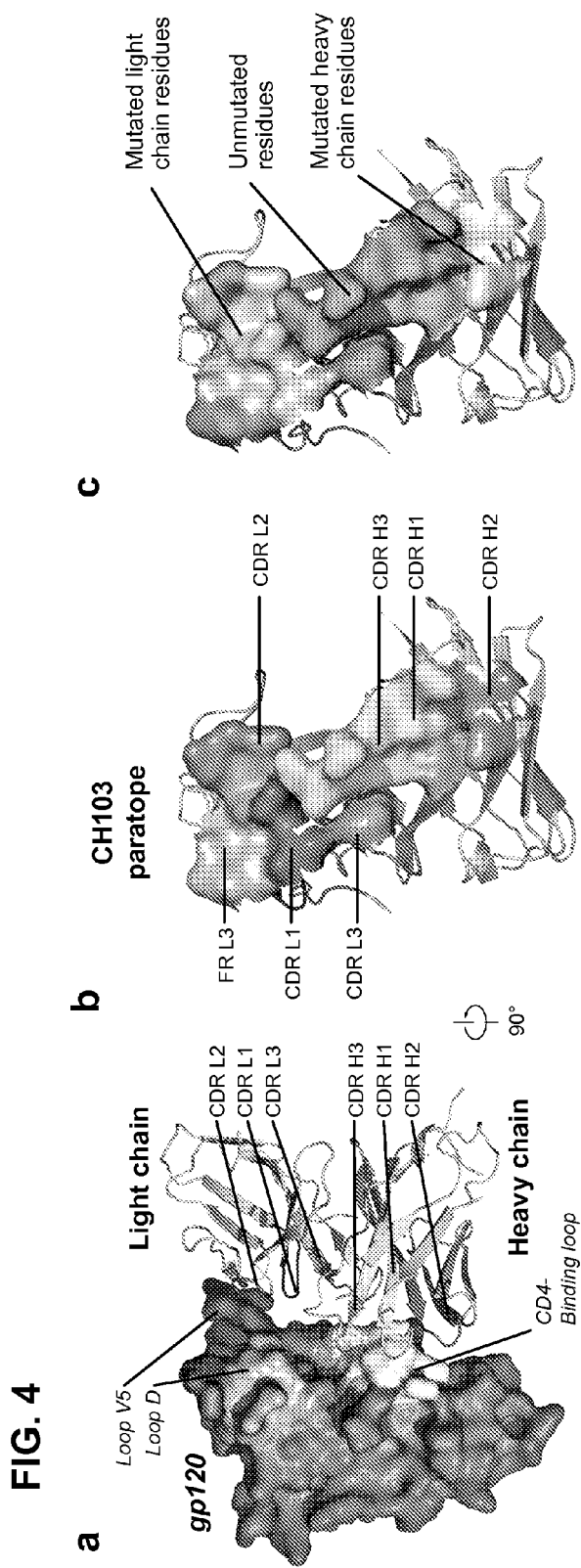
FIGS. 4A-4D. CH103 paratope, critical residues, and required immune precursors.

The proportion of sequences with all three characteristics, if independent is VH4-59/JH4/CDR3 Length=15 is 1/540 with the actual count in the analyzed data set of the combinantion=637/386853=1/607. This frequency is clearly very common. The question that remains regards the prevalence of the relevant characteristics of CDR3. For example, the HC CDR3 contact residues (from FIG. 4 of the paper) are RGQLVN (SEQ ID NO: 926) starting at position 4 in HCDR3 with the following conservative substitutions: R: K; G: A; Q: E; L: I, V; V: I, V; N: D. We therefore use the HCDR3 motif: XXX(R/K)(G/A)(Q/E)(L/V/I)(L/V/I)(N/D)nX, and scanned our pyrosequencing heavy-chain dataset for its occurrence. This motif occurred 10 times among the 337567 in-frame HCDR3 in our pyrosequencing database. If we allow positions other than the fourth (which contains the R/K necessary for the salt bridge) to vary we obtain the table below. The number of positions at which the observed HCDR3 differs from the CH103 HCDR3 motif is on the left, and the number out of 337567 HCDR3 seqeunces is on the right. All of the CDR3 in this table have R or K at position 4.

distance number of sequences out of 337567
0 10
1 71
2 1028

An appropriate light-chain UCA is also likely to be readily available. We downloaded 2312 rearranged human lambda V-region sequences from Genbank and analyzed them for comparison. The CH103 light chain uses IGLV3-1 and IGLJ1. These genes are found in 9.6% and 15.5% respectively of all sequences in the Genbank lambda database. The CH103 light chain is 30 nt long, as are 23.7% of the Genbank lambdas. The single contact residue in the light-chain CDR3 is tryptophan at the $3^{rd}$ CDR3 position, which is encoded by the IGLV gene. Indeed 43% of all Genbank lambda chains have W at position 3 of CDR3. Thus, there is considerable evidence that the germlines of the CH103 lineage are relatively common by a variety of criteria. FIG. 44 corresponds to, and is referred to, as Table 12 throughout the specification.

Figure 5:
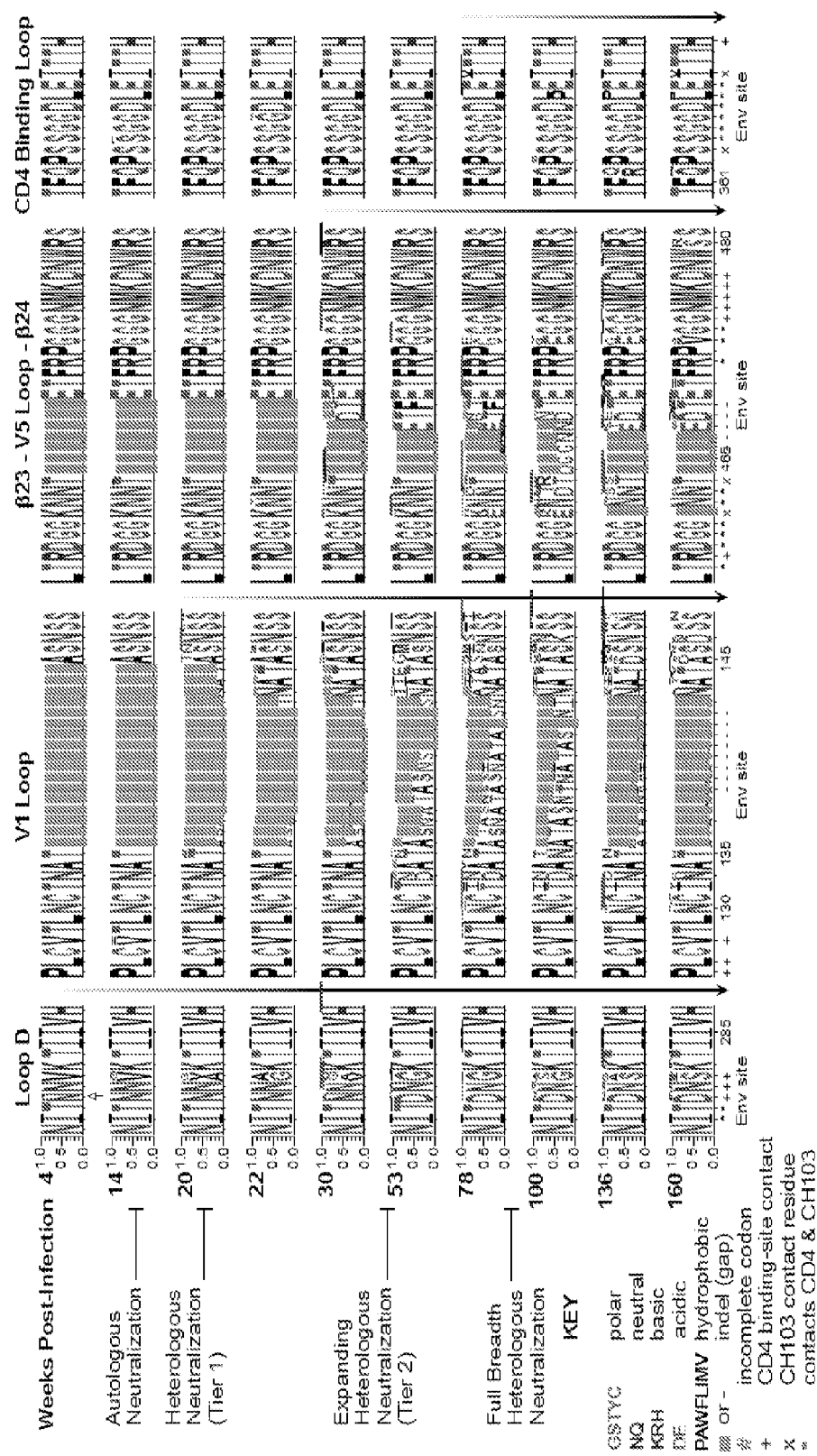
FIG. 5. Sequence Logo displaying variation in key regions of Ch505 Envs. The frequency of each amino acid variant per site is indicated by its height, deletions are indicated by grey bars. The first recurring mutation, N279K, appears at week 4 (open arrow). The timing of BnAb activity development (from FIG. 8 and Table 1) is on the left. Viral diversification, which precedes acquisition of breadth, is highlighted by vertical arrows to the right of each region. CD4 and CH103 contact residues, and amino acid position numbers based on HIV-1 HXB2, are shown along the base of each Logo column.

FIG. 45 shows localization of sites under positive selection using the fixed effects likelihood (FEL)[1](p-value <0.10) and the mixed effects model of evolution MEME[2] (q-value <0.1). [2]Number of positively selected sites; [b]Number of negatively selected sites; [c]Number of positively selected sites among 92 sites inside CH103 binding regions (footprint); [d]Number of positively selected sites among 830 sites not in CH103 footprint; [e]P value from Fisher's exact test for positively selected sites inside vs. outside CH103 footprint; [f]P value from Fisher's exact test for negatively selected sites inside vs. outside CH103 footprint; and [g]Per-site substitution rate among 922 aligned sites. The 922 codons in the CH505 alignment were considered as 2 sets: 92 codons (10%) were included in the candidate regions for CH103 selection (CH103, CD4, and VRC01 contact residues, as well as V1 and V5 hypervariable loops which border these contacts), and the 830 other codons remaining in the alignment. We used FEL[1] and MEME[2] methods to quantify selection in the CH505 codon-aligned sequences, implemented through the HyPhy package at the DATAMONKEY website (www.datamonkey.org). The full alignment was used for the initial analysis, and the codon sets defined above were used to see if positive selection was concentrated in the CH103 contact/CD4bs region. We used the strategy implemented at the DATAMONKEY web site to select optimal substitution models, with a p<0.10 cutoff as evidence suggesting positive selection for the FEL model, and a q<0.10 cutoff for the MEME model. Analysis by using both FEL and MEME methods showed that positive selection was enriched in CH103 binding regions by week 20, and this focus continued throughout the course of the study, through week 160.Fisher's exact test was used to test the null hypothesis that the positively selected sites are evenly distributed throughout Env; they are not, and are enriched in the CH103 region. In contrast, the number of sites under negative selection was evenly distributed between the two regions. The amino acids that are changing in the regions of interest for CH103 escape are shown in FIG. 5. At week 4, using FEL[1] and MEME[2], there was no statistical evidence for positive selection anywhere in the CH505 codon-aligned sequences, though there was evidence for negative selection at 6 positions with p values below the cutoff. However, FEL and MEME will underestimate positive selection within a subject, as the frequencies of identical sequences are not considered, and thus changes in population frequency are not considered positive selection. Given this, it is of note that in the week-4 sample, a single mutation in the full alignment of 55 sequences occured more than once, and it was a N279K change in Loop D, found in 5 of the 55 sequences. There was also one instance of a short (7 residue) in-frame deletion spanning this position. This would produce just one ancestral change in the phylogenetic tree, so it could not provide statistical evidence of selection, but still coincidence of facts makes it of interest: 279 is located in a key contact position for CH103 in Loop D, in a region under clear strong subsequent selective pressure. Neighboring positions are mutating by week 14, a further indication that local positive selection might be underway, leaving open the possibility that these sites may targeted by the CH103 lineage very early in infection. Codon models also do not take into account insertions and deletions, an essential aspect of HIV env evolution, which is evident in CH505 in V1 by week 20. 1. Kosakovsky Pond, S.L. & Frost, S.D. Not so different after all: a comparison of methods for detecting amino acid sites under selection. Molecular biology and evolution 22, 1208-1222 (2005). 2. Murrell, B., et al. Detecting individual sites subject to episodic diversifying selection. PLoS genetics 8, e1002764 (2012). FIG. 45 corresponds to, and is referred to, as Table 13 throughout the specification.

FIG. 46 shows autologous and heterologous neutralization activity of CH103 clonal lineage antibodies. FIG. 46 corresponds to, and is referred to, as Table 14 throughout the specification.

FIG. 47 shows alignment of gp160 Env sequences of CH505 transmitted/funder (T/F) and tested heterologous HIV-1 viruses. FIG. 47 corresponds to, and is referred to, as Table 15 throughout the specification.

DETAILED DESCRIPTION OF THE INVENTION

The results of the study described in the Example that follows demonstrate that the binding of a T/F Env to a UCA B cell receptor of a BnAb lineage was responsible for the induction of broad neutralizing antibodies, thus providing a logical starting place for vaccine-induced CD4bs BnAb clonal activation and expansion. Importantly, the number of mutations required to achieve neutralization breadth was reduced in the CH103 lineage compared to most CD4bs BnAbs, although the CH103 lineage had reduced neutralization breadth compared to more mutated CD4bs BnAbs. By tracking viral evolution through early infection, it was found that intense selection and epitope diversification in the T/F virus preceded the acquisition of NAb breadth in this individual—thus demonstrating the viral variants or combination of variants associated with development of BnAbs directly from autologous neutralizing antibodies and illuminating a pathway for induction of similar B cell lineages. (See viral envelope sequences (and encoding sequences) in FIGS. 17A, B and 19A-D.) The envelopes to be used as immunogens can be expressed as full gp140, gp145 with transmembrane portions, gp120s, gp120 resurfaced core proteins, gp120 outer domain constructs, or other minimal gp120 constructs with portions of the CH103 contacts such as the gp120 D loop, the V5 loop and the CD4 binding site loop region expressed such that the UCA, and/or Intermediate antibodies and/or mature CH103, CH104, CH105, and CH106 mature antibodies bind to the immunogen constructs.

Figure 18:
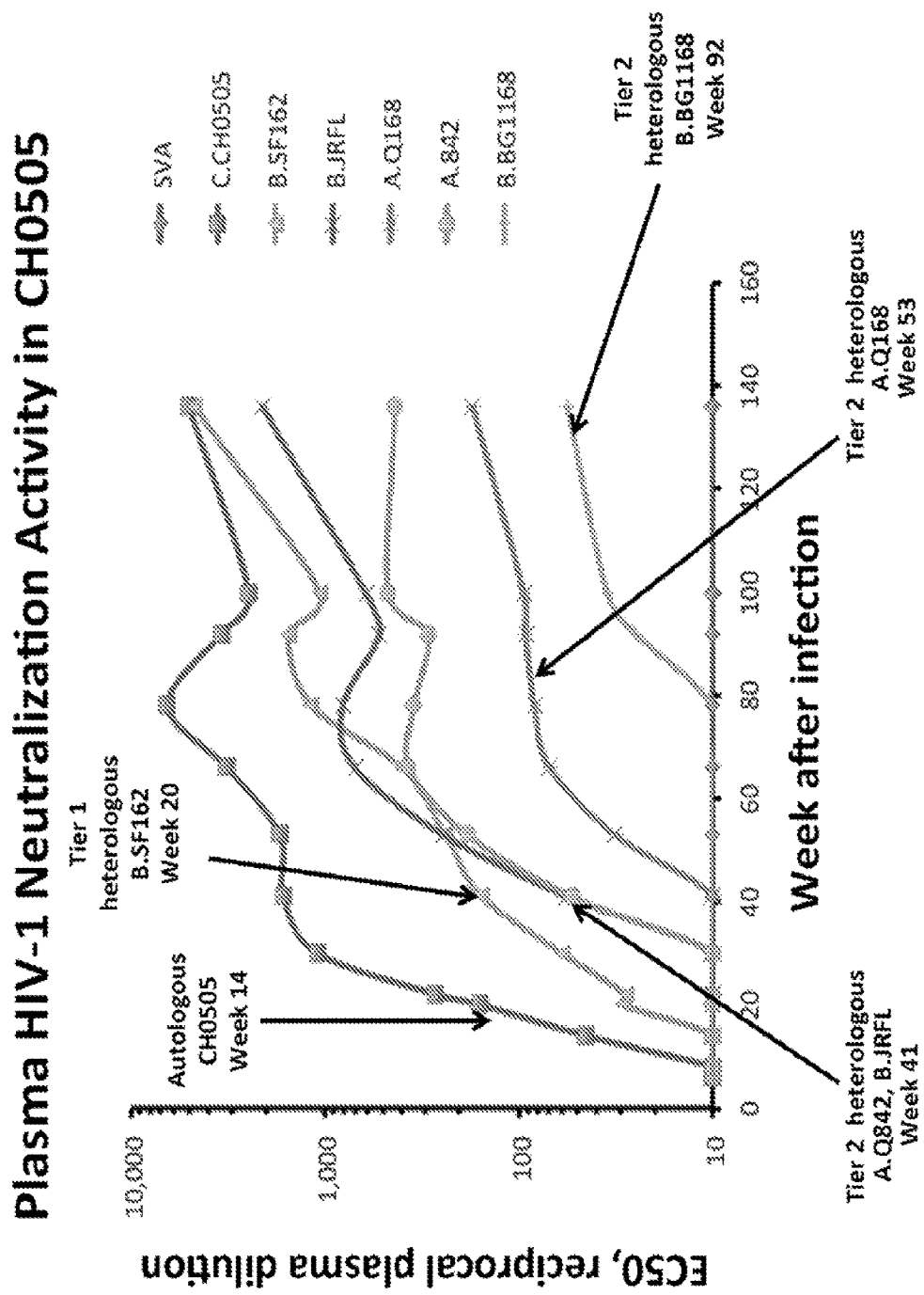
Figure 18:
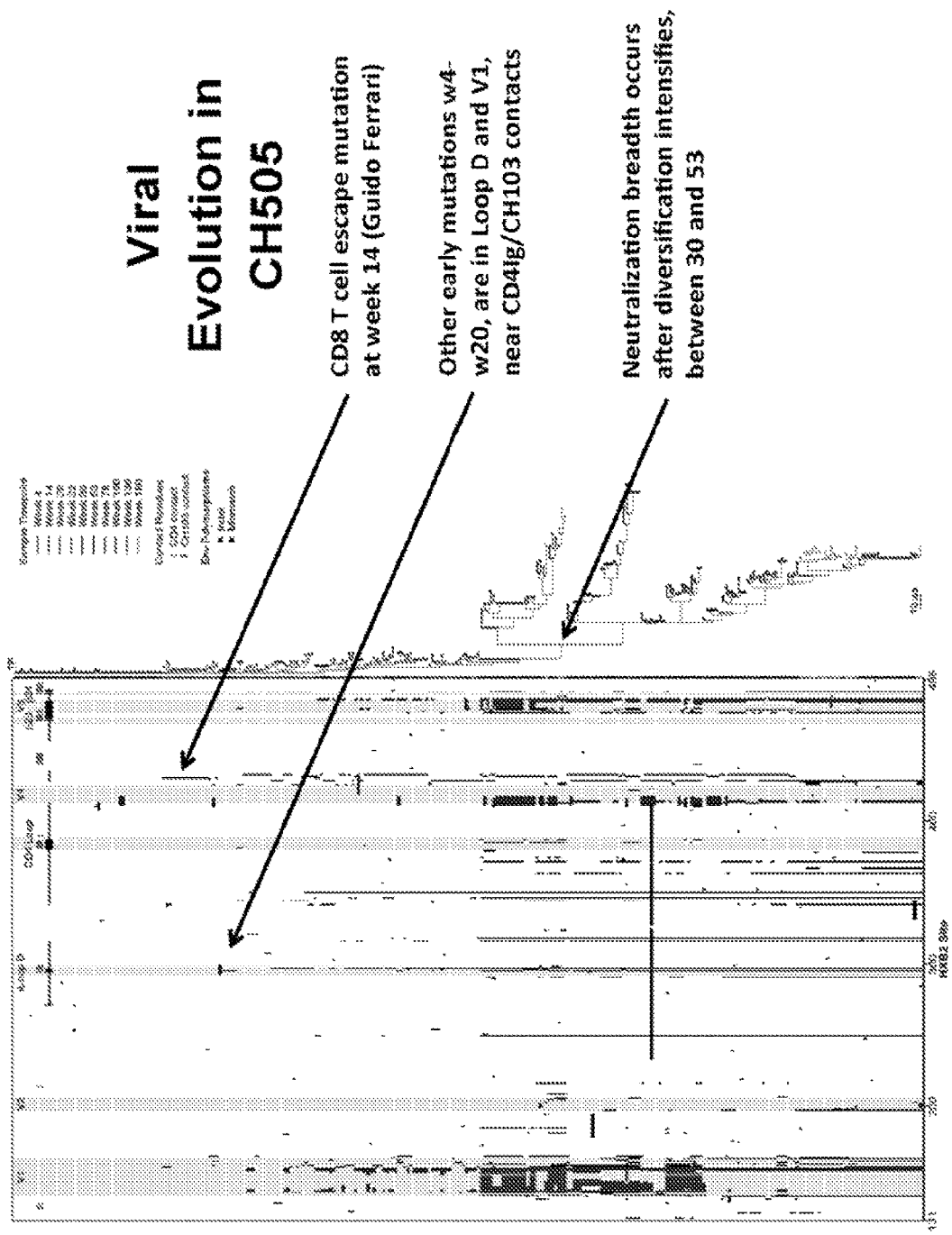
Figure 18:
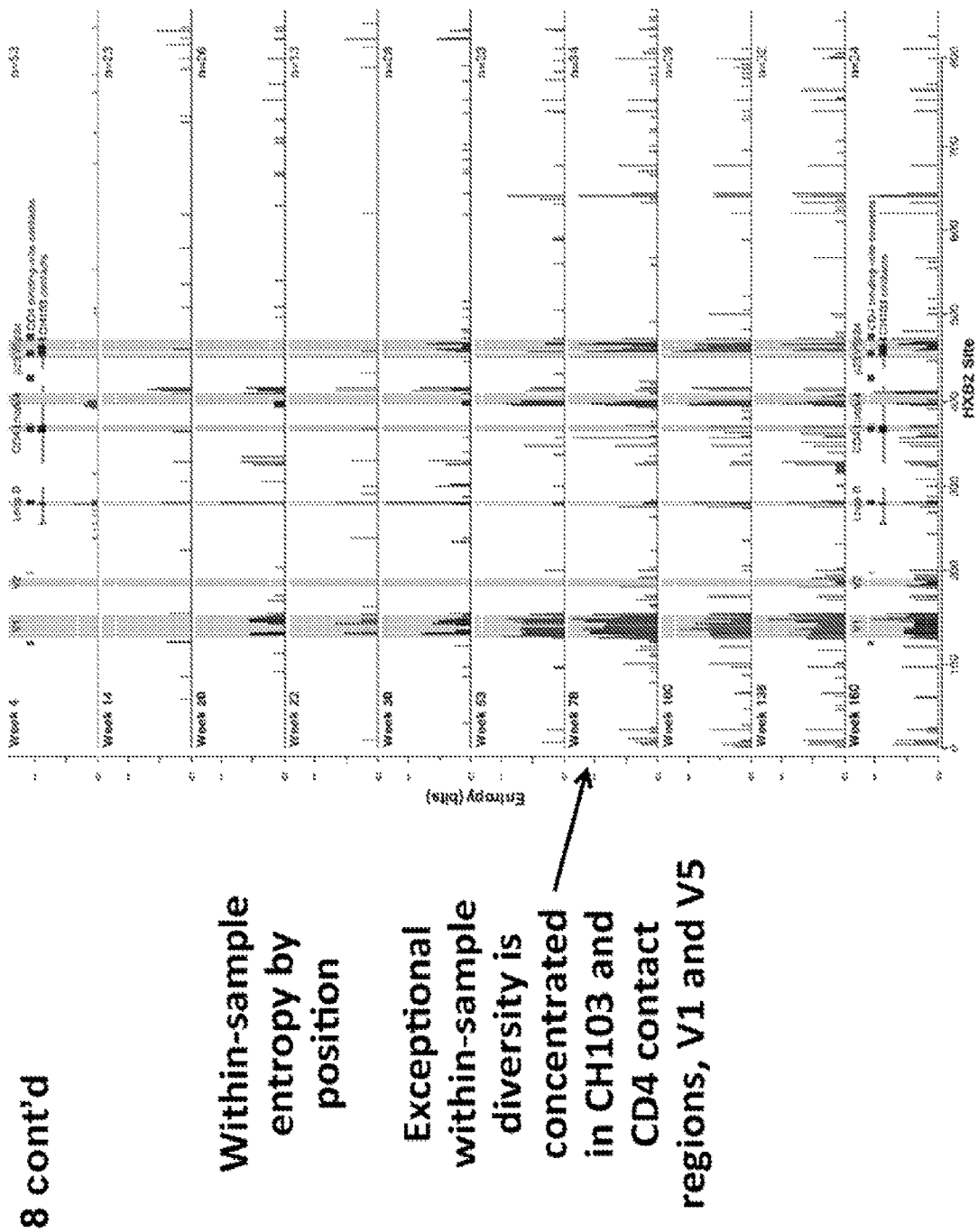
Figure 18:
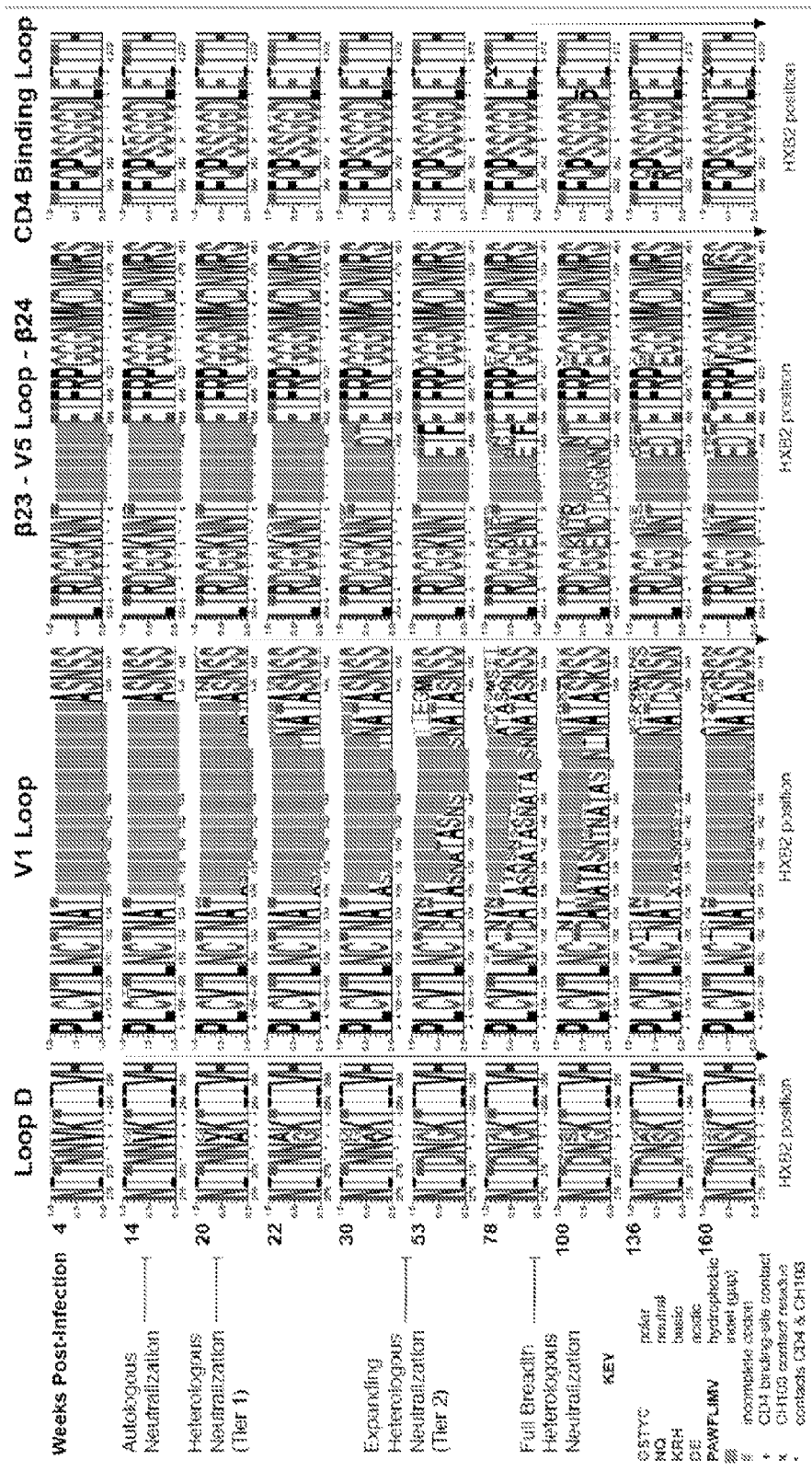
Figure 18:
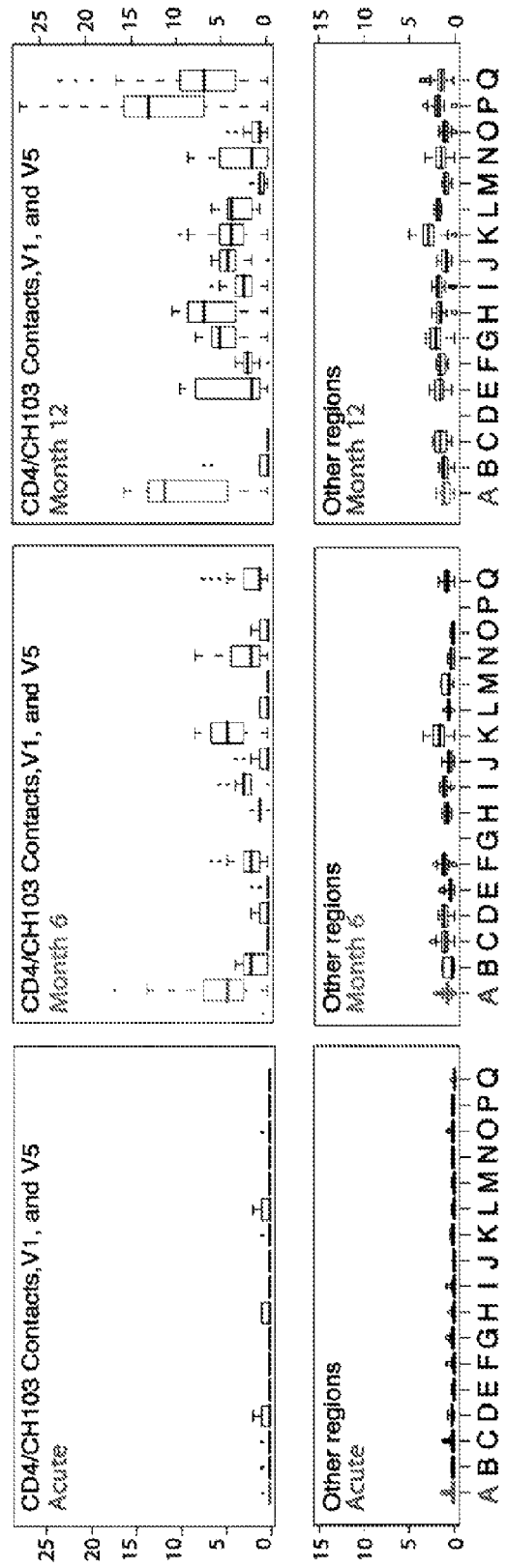
Figure 18:
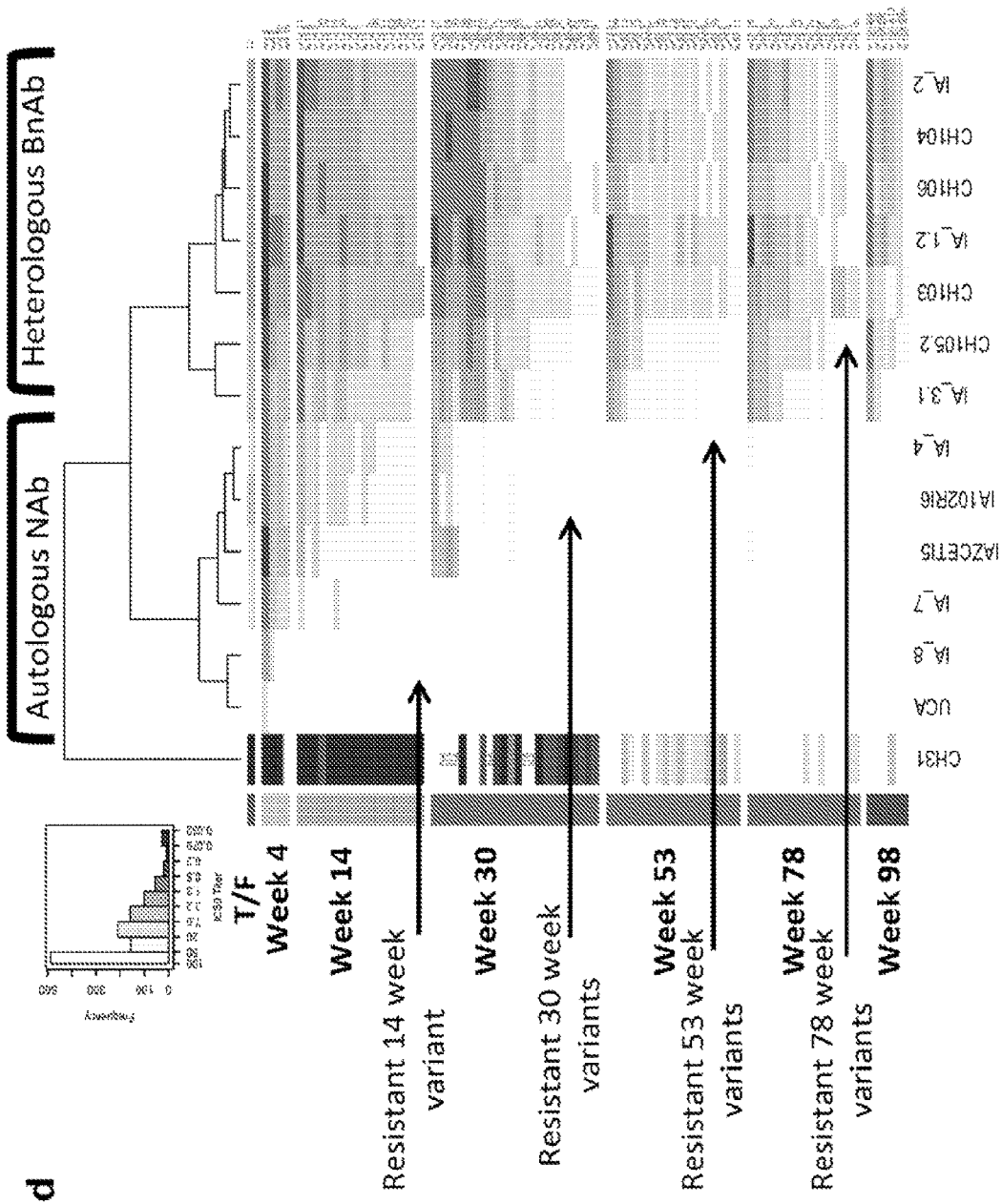
Figure 18:
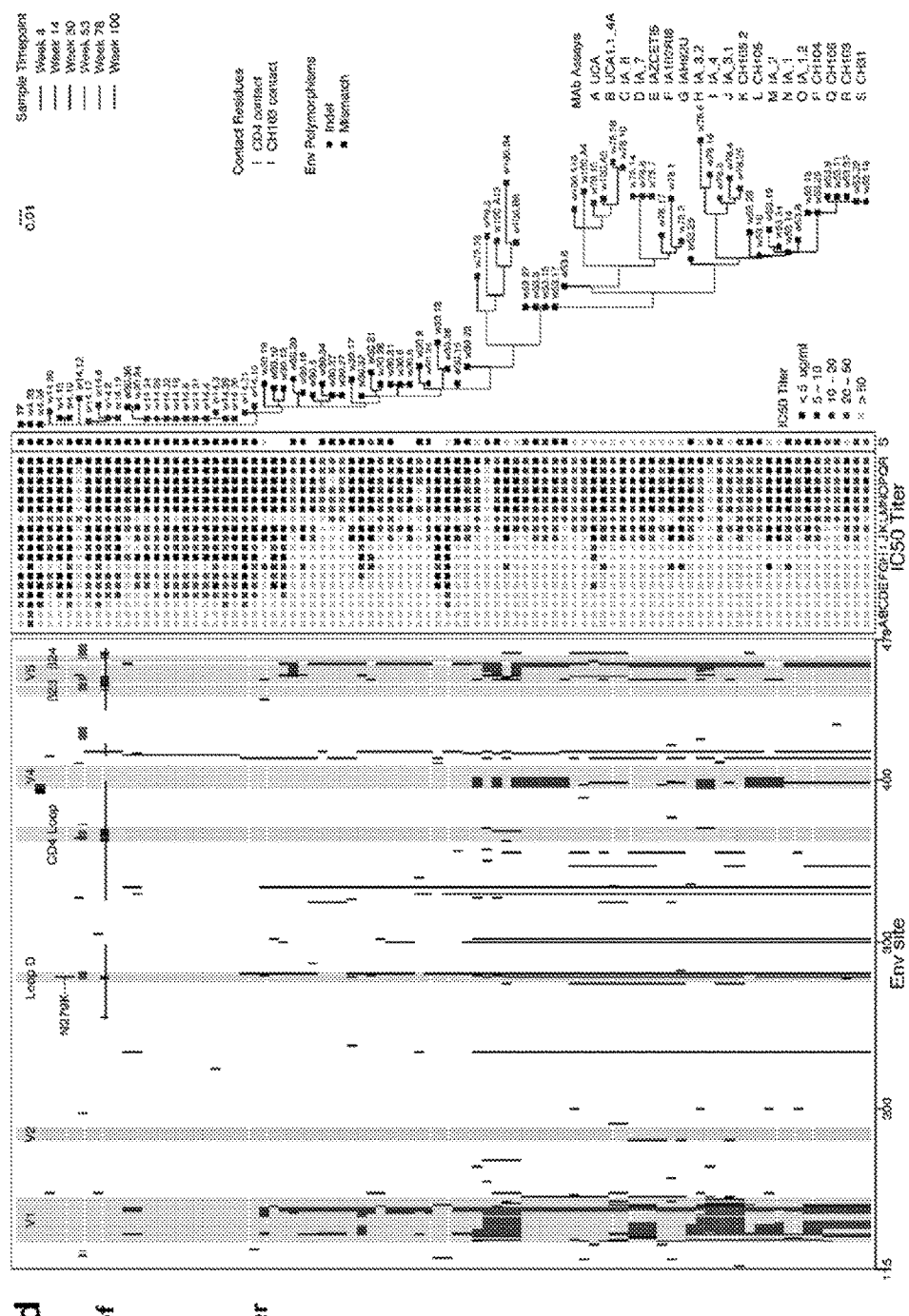
Figure 18:
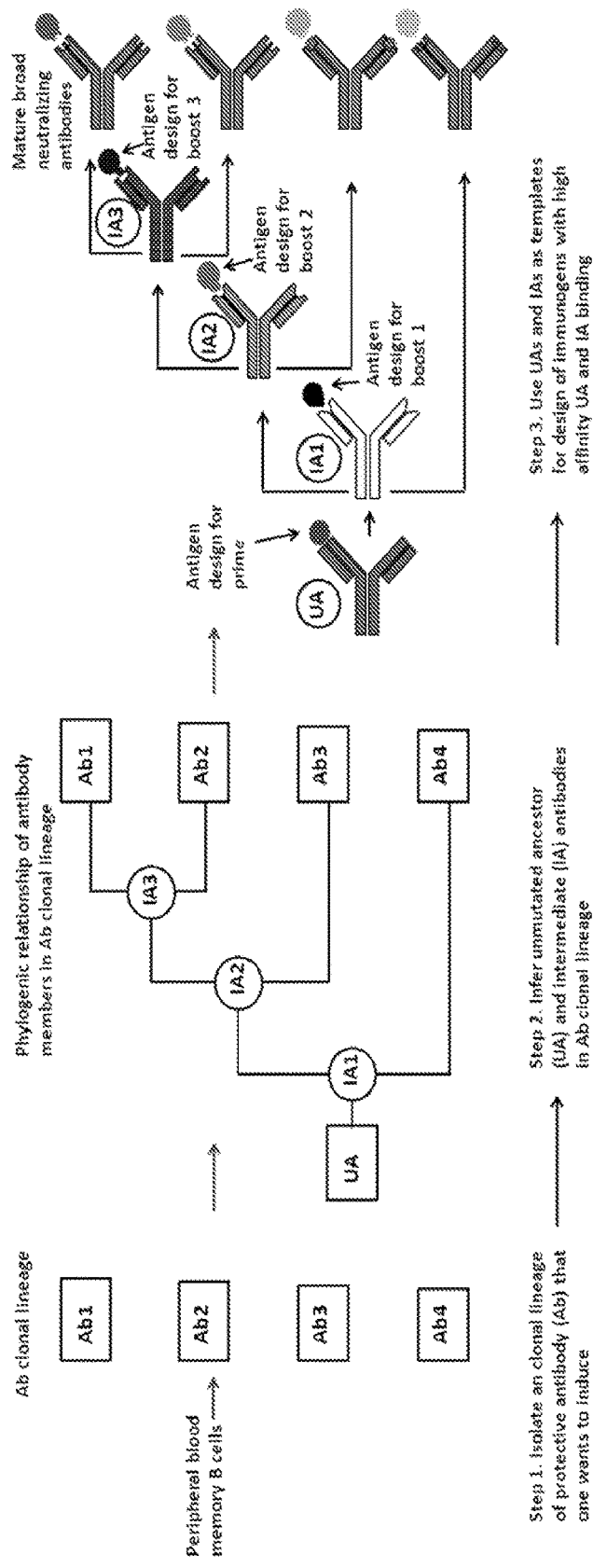
Figure 19A:
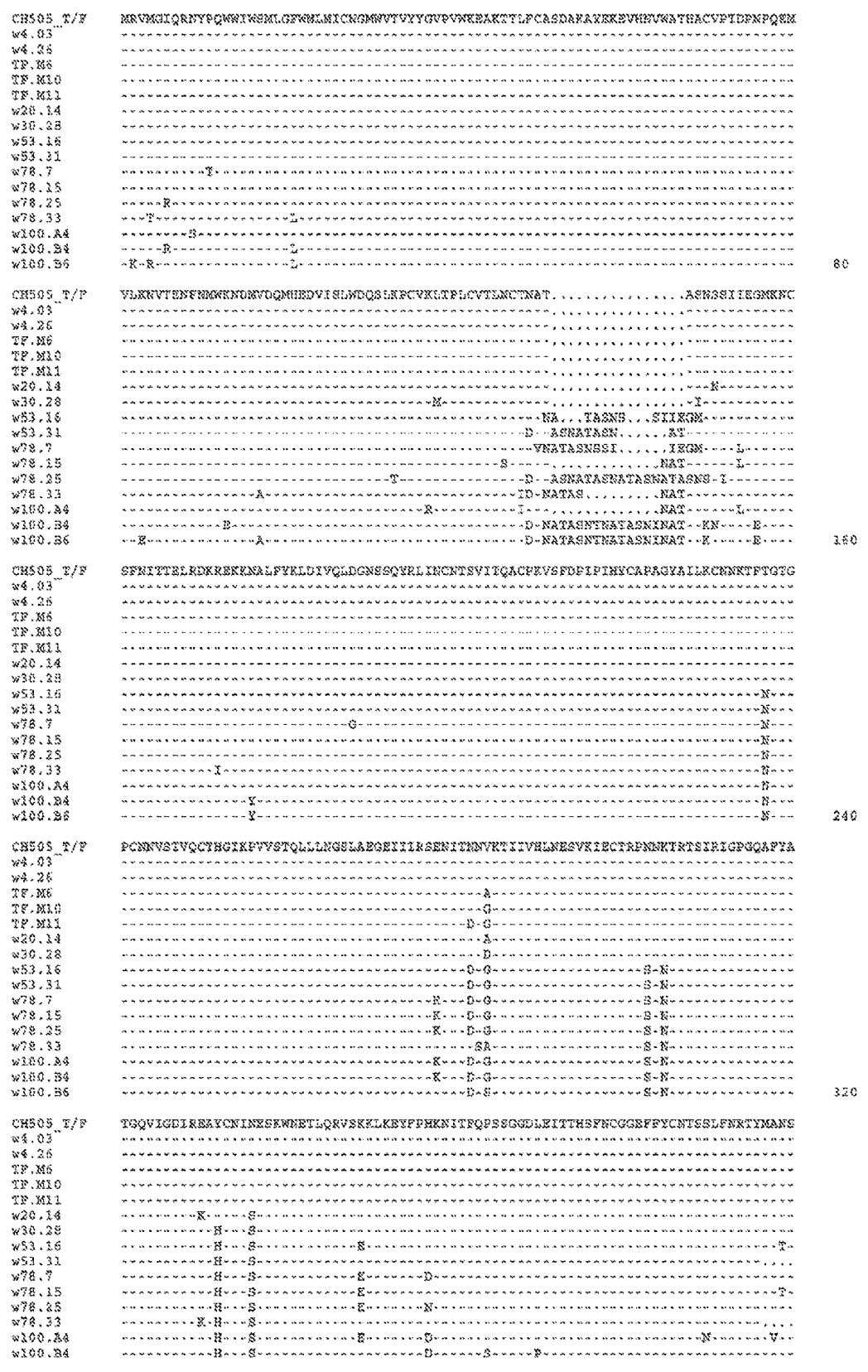

In accordance with the invention, immunization regimens can include sequential immunizations of Env constructs selected from FIGS. 17 and 19, or can involve prime and boosts of combinations of Envs, or the administration of "swarms" of such sequences (e.g., those in FIG. 19A-D). Immunogenic fragments/subunits can also be used as can encoding nucleic acid sequences. Alternatively, the transmitted founder virus Env constructs can be used as primes, followed by a boost with the transmitted founder Env and sequential additions of Envs from progressively later times after transmission in patient CH505. Further, repetitive immunization can be effected with "swarms" of CH505 Envs (for example, including various combinations of the proteins and nucleic acid sequences in FIGS. 19A-D) ranging from, for example, 2 to 40 Envs. Examples of vaccine strategies of the invention are shown in FIG. 18.

The data provided in the Examples below have implications for understanding the B cell maturation pathways of the CH103 lineage and for replicating similar pathways in a vaccine setting. First, it was demonstrated in CH505 that BnAbs were driven by sequential Env evolution beginning as early as 14 weeks after transmission, a time period compatible with induction of this type of BnAb lineage with a vaccine given the correct set of immunogens. Second, whereas heterologous Envs did not bind with UCAs or early intermediate antibodies of this lineage, the CH505 T/F Env bound remarkably well to the CH103 UCA, and subsequent Envs bound with increased affinity to later clonal lineage members. Thus, immunizations with similar sequences of Env or Env subunits can be expected drive similar lineages. Third, the CH103 lineage is less complicated than those of the VRC01-class of antibodies because antibodies in this lineage have fewer somatic mutations, and no indels, except CH103 $V_L$ has a deletion of 3 amino acid residues in the LCDR1 region. The study described in the Example 1 below was in one patient. Nonetheless, in each BnAb patient, analysis of viral evolution should elucidate a similar pathway of evolved Envs that induce BnAb breadth. The observation that rhesus macaques infected with the CCR5-tropic SHIV-AD8 virus frequently develop neutralization breadth (Shingai et al, Proc. Natl. Acad. Sci. USA 109:19769-19774 (2012)) indicates that certain envelopes may be more likely to induce breadth and potency than others.

Polyreactivity to host molecules in the CH103-lineage arose during affinity maturation in the periphery coincident with BnAb activity. This finding is compatible with the hypothesis that BnAbs may be derived from an inherently polyreactive pool of B cells, with polyreactivity providing a neutralization advantage via heteroligation of Env and host molecules (Mouquet et al, Nature 467:591-595 (2010), Alam et al, J. Immunol. 178:4424-4435 (2007)). Alternatively, as CH103 affinity maturation involves adapting to the simultaneous presence of diverse co-circulating forms of the epitope (Malherbe et al, J. Virol. 85:5262-5274 (2011)), the selection of antibodies that can interact with extensive escape-generated epitope diversification may be an evolutionary force that also drives incidental acquisition of polyreactivity.

Thus, in one embodiment, the present invention relates to a method of activating an appropriate naïve B cell response in a subject (e.g., a human) by administering the CH505 T/F Env or Env subunits that can include the gp145 with a transmembrane portion, gp41 and gp120, an uncleaved gp140, a cleaved gp140, a gp120, a gp120 subunit such as a resurfaced core (Wu X, Science 329:856-61 (2010)), an outerdomain, or a minimum epitope expressing only the contact points of CH103 with Env, i.e., the gp120 D loop, the V5 loop and the CD4 binding site loop region (the minimal epitope to avoid dominant Env non-neutralizing epitopes), followed by boosting with representatives of the subsequently evolved CH505 Env variants (e.g., those in FIGS. 17 and 19) either given in combination to mimic the high diversity observed in vivo during affinity maturation, or in series, using vaccine immunogens specifically selected to trigger the appropriate maturation pathway by high affinity binding to UCA and antibody intermediates (Haynes et al, Nat. Biotechnol. 30:423-433 (2012)). DNA, RNA, protein or vectored immunogens can be used alone or in combination. In one embodiment of the invention, transmitted founder virus envelope (e.g., B.6240 (see also FIG. 17)) is administered to the subject (e.g., human) as the priming envelope and then one or more of the sequential envelopes disclosed herein is administered as a boost in an amount and under conditions such that BnAbs are produced in the subject (e.g., human). By way of example, 2, 3, 4, 5, 6, 7, 8, 9, 10, 11, 12, 13, 14, 15, 16, 17 or 18 envelopes (or subunits thereof) (e.g., from FIG. 19) can be used with one prime and multiple boosts.

The data provided in the Examples demonstrate the importance of studying subjects followed from the transmission event through the development of plasma BnAb activity for concomitant isolation of both T/F viruses and their evolved quasispecies along with the clonal lineage of induced BnAbs. The finding that the T/F Env can be the stimulator of a potent BnAb and bind optimally to that BnAb UCA is a critical insight for vaccine design, and makes possible the induction of BnAbs by targeting UCAs and IAs of BnAb clonal lineage trees (Haynes et al, Nat. Biotechnol. 30:423-433 (2012)).

The present invention includes the specific envelope proteins disclosed herein (e.g., those in FIG. 17A and FIG. 19A-D) and nucleic acids comprising nucleotide sequences encoding same (e.g., those in FIG. 17B). Preferred sequences (amino acid and nucleic acid) include those designated 703010505.TF, 703010505.w53.16, 703010505.w78.33 and 703010505.w100.B6. The envelope proteins (and subunits) can be expressed, for example, in 293T cells, 293F cells or CHO cells (Liao et al, Virology 353:268-82 (2006)). As indicated above, the envelope proteins can be expressed, for example, as gp120 or gp140 proteins and portions of the envelope proteins can be used as immunogens such as the resurfaced core protein design (RSC) (FIG. 28) (Wu et al, Science 329:856-861 (2010)); another possible design is an outer domain design (FIG. 29) (Lynch et al, J. Virol. 86:7588-95 (2012)). The invention includes immunogenic fragments/subunits of the envelope sequences disclosed herein, including fragments at least 6, 10, 20, 30, 40, 50, 60, 70, 80, 90, 100, 120, 140, 160, 180, 200, 220, 240, 260, 280 300, 320 or more amino acids in length, as well as nucleic acids comprising nucleotide sequences encoding such fragments and vectors containing same.

In other embodiments, the invention provides variants of the sequences in FIG. 17, wherein the variants comprise a mutation which repairs a trypsin cleavage site, thereby preventing protein clipping during Env protein production in a cell line, e.g., a CHO cell line. Non-limiting examples of such trypsin resistant variants are shown in FIG. 19D (the portion of the document called constructs cleavage site mutations). In one embodiment, amino acid "A" at position 289 in CH0505TF 7gp120 is changed to "T", and amino acid "Q" at position 295 is changed to "D." The invention contemplates trypsin resistant Env variants that include changes at the corresponding positions in any of the Env sequences in FIG. 17.

The envelopes (immunogens) can be formulated with appropriate carriers using standard techniques to yield compositions suitable for administration. The compositions can include an adjuvant, such as, for example, alum, poly IC, MF-59 or other squalene-based adjuvant, ASOIB or other liposomal based adjuvant suitable for protein immunization.

As indicated above, nucleic acid sequences (e.g., DNA sequences) encoding the immunogens can also be administered to a subject (e.g., a human) under conditions such that the immunogen is expressed in vivo and BnAbs are produced. The DNA can be present as an insert in a vector, such as a rAdenoviral (Barouch, et al. Nature Med. 16: 319-23 (2010), recombinant mycobacterial (i.e., BCG or *M smegmatis*) (Yu et al. Clinical Vaccine Immunol. 14: 886-093 (2007); ibid 13: 1204-11 (2006), or recombinant vaccinia type of vector (Santra S. Nature Med. 16: 324-8 (2010)).

Immunogens of the invention, and nucleic acids (e.g., DNAs) encoding same, are suitable for use in generating an immune response (e.g., BnAbs) in a patient (e.g., a human patient) to HIV-1. The mode of administration of the immunogen, or encoding sequence, can vary with the particular immunogen, the patient and the effect sought, similarly, the dose administered. Typically, the administration route is intramuscular or subcutaneous injection (intravenous and intraperitoneal can also be used). Additionally, the formulations can be administered via the intranasal route, or intrarectally or vaginally as a suppository-like vehicle. Optimum dosing regimens can be readily determined by one skilled in the art. The immunogens (and nucleic acids encoding same) are preferred for use prophylactically, however, their administration to infected individuals may reduce viral load.

Previous attempts to use sequential immunizations with Env proteins that have developed over time in humans or animals that have developed neutralization breadth have failed, primarily because the viruses have been isolated but the envelope immunogens have not been matched to bind to the BnAbs themselves, i.e., they are not antigenic. That is, in the two studies that have isolated Envs over time in BnAb subjects, no transmitted founder viruses or subsequent (sequential) viruses were available and thus the correct Env immunogens to choose were not apparent (Malherbe et al, J Virol. 85:5262-74 (2011); Pissoni, Vaccine 30:5519-26 (2012)). What is different here is that both the BnAbs and the virus Env sequences tht drove the induction and maturation of the BnAbs are known, and, thus, those envelopes can be chosen with mutations in the CD4 binding site or in regions that are important for CD4 binding site BnAb binding, such as V5 loop region (Zhou et al, Science 329:811-17 (2010); Wu et al, Science 333:1593-602 (2011)).

Certain aspects of the invention can be described in greater detail in the non-limiting Examples that follow. (See also U.S. Provisional Application No. 61/542,469, filed Oct. 3, 2011, U.S. Provisional Application No. 61/700,234, filed Sep. 12, 2012, U.S. Provisional Application No. 61/708,413, filed Oct. 1, 2012, U.S. Provisional Application No. 61/700, 252, filed Sep. 12, 2012, U.S. Provisional Application No. 61/708,466, filed Oct. 1, 2012, U.S. Provisional Application No. 61/708,503, filed Oct. 1, 2012, U.S. Provisional Application No. 61/806,717, filed Mar. 29, 2013, U.S. application Ser. No. 13/314,712, filed Dec. 8, 2011 and PCT/US2012/000442, filed Oct. 3, 2012, the entire contents of each of which are incorporated herein by reference.)

Example 1

Experimental Details

In summary, serial blood samples were collected from a HIV-1 infected subject CH505 starting 4 weeks after infection up to 236 weeks after infection. MAbs CH103, CH104 and CH106 were generated by the isolation, amplification and cloning of single RSC3-specific memory B cells as described (Scheid et al, J. Immunol. Methods 343:65-67 (2009), Wu et al, Science 329:856-861 (2010), Wu et al, Science 333:1593-1602 (2011), Zhou et al, Science 329: 811-817 (2010), Scheid et al, Science 333:1633-1637 (2011)). $V_HDJ_H$ and $V_LJ_L$ 454 pyrosequencing was performed on samples from 5 timepoints after transmission (Wu et al, Science 333:1593-1602 (2011)). Inference of unmutated ancestor (UCA), identification and production of clone members were performed using the methods as described (Liao et al, J. Exp. Med. 208:2237-2249 (2011)) (Kepler, T. B. submitted, 2012). Additional $V_HDJ_H$ and $V_LJ_L$ and $V_LJ_L$ genes were identified by 454 pyrosequencing (Wu et al, Science 333:1593-1602 (2011), Liao et al, J. Exp. Med. 208:2237-2249 (2011), Boyd et at, Sci. Transl. Med. 1:12ra23 (2009)) and select $V_HDJ_H$ and $V_LJ_L$ genes were used to produce recombinant antibodies as reported previously (Liao et al, J. Exp. Med. 208:2237-2249 (2011)). Binding of patient plasma antibodies and CH103 clonal lineage antibody members to autologous and heterologous HIV-1 Envs was measured by ELISA and surface plasmon resonance (Alam et al, J. Virol. 85:11725-11731 (2011), Liao et al, J. Exp. Med. 208:2237-2249 (2011), Alam et al, J. Immunol. 178:4424-4435 (2007), Alam et al, J. Virol. 82:115-125 (2008)), and neutralizing activity of patient plasma and CH103 antibody clonal lineage members was determined in a TZM-bl-based pseudovirus neutralization assay (Wu et al, Science 329:856-861 (2010), Seaman et al, J. Virol. 84:1439-1452 (2010), Montefiori, Cur. Protoc. Immunol., Chapter 12, Unit 12 11 (2005)). Crystallographic analysis of CH103 bound to HIV-1 outer domain was performed as previously reported (Zhou et at, Science 329: 811-817 (2010)). The GenBank accession numbers for 292 CH505 Envs are KC247375-KC247667, for 459 $V_HDJ_H$ are 174 $V_LJ_L$ sequences of antibody members in CH103 clonal lineage are KC575845-KC576303 and KC576304-KC576477, respectively. Coordinates and structure factors for unbound CH103 Fab as well as CH103 Fab in complex with ZM176.66 outer domain have been deposited with the Protein Data Bank.

The methods used are described in greater detail below.

Study Subject.

Plasma and peripheral blood mononuclear cells (PBMC) were isolated from serial blood samples that were collected from a HIV-1 infected subject CH505 starting 6 weeks after infection up to 236 weeks after infection (Table 1) and frozen at ~80° C. and liquid nitrogen tanks, respectively. During this time, no anti-retroviral therapy was administered. All work related to human subjects was in compliance with Institutional Review Board protocols approved by the Duke University Health System Institutional Review Board.

Inference of Unmutated Common Ancestor (UCA) and Identification of Clone Members.

The variable regions of heavy- and light chain ($V_HDJ_H$ and $V_LJ_L$) gene segments were inferred from the natural pairs themselves. The posterior probabilities for these two gene segments are 0.999 and 0.993, respectively. The UA was first inferred from the natural pairs. Additional clonally related variable region sequences were then identified from deep sequencing and the estimate of the UCA refined iteratively. All variable region sequences inferred were identified to have been rearranged to the same $V_HDJ_H$ and $J_H$, and to have the correct CDR3 length. For each sequence, a count was made of the number of mismatches between the sequence and the presumed $V_HDJ_H$ gene up to the codon for the second invariant cysteine. Each iteration was based on the CDR3 of the current posterior modal UA. For each candidate sequence, the number of nucleotide mismatches between its CDR3 and the UA CDR3 were computed. The sequence was rejected as a potential clone member if the z-statistic in a test for difference between proportion is greater than two (Zar, Biostatistical Analysis, entice-Hall, Inc., Upper Saddle River, N.J. (1974)). Once the set of candidates has been thus filtered by CDR3 distance, the UA was inferred on that larger set of sequences as described (Haynes et al, Nat. Biotechnol. 30:423-433 (2012), Ma et al, PLoS Pathog. 7:e1002200 (2001), Liao et al, J. Exp. Med. 208:2237-2249 (2011)). The paper, Kepler, T. B., Reconstructing a B cell clonal lineage: 1. Statistical Inference of Unobserved Ancestors, that describes the methods and their mathematical basis in detail has been deposited to the arXiv preprint collection arxiv.org/ at Cornell. If the new posterior modal UA differed from the previous one, the process was repeated until convergence was reached. Due to the greatest uncertainty occurring in the CDRH3, from the $V_HDJ_H$ sequences derived from observed antibodies and sequences identified by 454 pyrosequencing, the 7 most likely VH UCA sequences were inferred resulting in 4 unique amino acid sequences that were all produced and assayed for reactivity with the transmitted/founder envelope gp140 (Table 5).

Isolation of $V_HDJ_H$ and $V_L$ Genes and Expression of $V_HDJ_H$ and $V_LJ_L$ Genes as Full-Length IgG1 Recombinant mAbs.

The $V_HDJ_H$ and $V_LJ_L$ gene segment pairs of the observed CH103, CH104 and CH106 and the $V_LJ_L$ gene segment of CH105 were amplified by RT/PCR of flow sorted HIV-1 Env RSC3 (re-surface core3)-specific memory B cells using the methods as described previously (Scheid et al, J. Immunol. Methods 343:65-67 (2009), Wu et al, Science 329:856-861 (2010), Wu et al, Science 333:1593-1602 (2011), Zhou et at, Science 329:811-817 (2010), Scheid et al, Science 333: 1633-1637 (2011). Additional $V_HDJ_H$ and $V_LJ_L$ and $V_LJ_L$ genes were identified by 454 pyrosequencing. Clonally related $V_HDJ_H$ and $V_LJ_L$ sequences derived from either sorted single B cells or 454 pyrosequencing were combined and used to generate neighbor-joining phylogenetic trees (FIGS. 2A and 2B). Antibodies that were recovered from single memory B cells are noted in the figure in red, and bolded lines show the inferred evolutionary paths from the UCA to mature BnAbs. For clarity, related $V_H$ variants that grouped within monophyletic clades from the same timepoint were collapsed to single branches, condensing 457 $V_HDJ_H$ and 174 V $V_LJ_L$ variants to 119 and 46 branches, respectively, via the "nw_condense" function from the Newick Utilities package (v. 1.6) (Junier and Zdobnov, Bioinformatics 26:1669-1670 (2010)). The frequencies of $V_HDJ_H$ variants in each B cell sample are shown to the right of the $V_HDJ_H$ tree in FIG. 2A, and were computed from sample sizes of 188,793, 186,626, and 211,901 sequences from weeks 53, 92, and 144, respectively. Two $V_HDJ_H$ genes (IZ95W and 02IV4) were found at 14 weeks alter transmission and paired with UCA $V_LJ_L$ for expression as IgG1 mAbs. IZ95W mAb weakly bound the CH505 T/F Env gp140 with end-point titer of 11 ug/ml. Among heavy chain sequences in the tree, the mean distance of each to its nearest neighbor to was calculated to be 8.1 nt. The cumulative distribution function shows that, while there are pairs that are very close together (nearly 30% of sequences are 1 nt from its neighbor), 45% of all sequences differ by 6nt or more from its nearest neighbor. The probability of generating a sequence that differs by 6 or more nucleotides from the starting sequence by PCR and sequencing is very small. The numbers of sequences obtained from a total of 100 million PBMC were within the expected range of 50-500 antigen-specific B cells.

Regarding the number of unique $V_HDJ_H$ and $V_LJ_L$ genes that have been isolated, this issue has been analyzed in a number of ways. First, the calculations have been clarified for the possible number of antigen-specific CD4bs memory B cells that could have been isolated from the samples studied. Five patient CH505 time points were studied with pyrosequencing with ~20 million PBMC per time point for a total of 100 million PBMC studied. In chronic HIV, there is a mean of 145 total B cells per ul of blood, and a mean of 60 memory B cells per ul of blood (Moir et al, The Journal of Infectious Diseases 197:572-579 (2008)). This high percent of memory B cells of ~40% of the total B cells in chronic HIV infection is due to selective loss of naïve B cells in HIV infection. Thus, in 100 ml (100,000 µl) of blood, there will be approximately 6 million memory B cells. If 0.1 to 1.0% are antigen specific, that that would be 6,000 to 60,000 antigen-specific B cells sampled, and if, of these, 5% were CD4bs antibodies, then from 300 to 3000 CD4 bs B cells would have been sampled in 100 million PBMC studied. This is completely compatible and within the range of the calculations of the reviewer above (50 CD4 bs B cells per 5 million PBMC), since studied 100 million PBMC, there should, by these calculations, 1000 CD4bs B cells sampled. Either calculation therefore yields estimates that are completely compatible with the 474 $V_HDJ_H$ genes amplified.

To further study the plausibility of sequences isolated, the second method of analysis used was as follows. Among heavy chain sequences in the tree, one can compute the distance of each to its nearest neighbor. The mean distance to the nearest neighbor is 8.1 nt. The cumulative distribution function shows that, while there are pairs that are very close together (nearly 30% of sequences are 1 nt from its neighbor), 45% of all sequences differ by 6nt or more from its nearest neighbor. The probability of generating a sequence that differs by 6 or more nucleotides from the starting sequence by PCR and sequencing is very small. It is believed that the number of genes represented in the sample is closer to 200 than to 50, and most likely is larger than 200.

Figure 2:
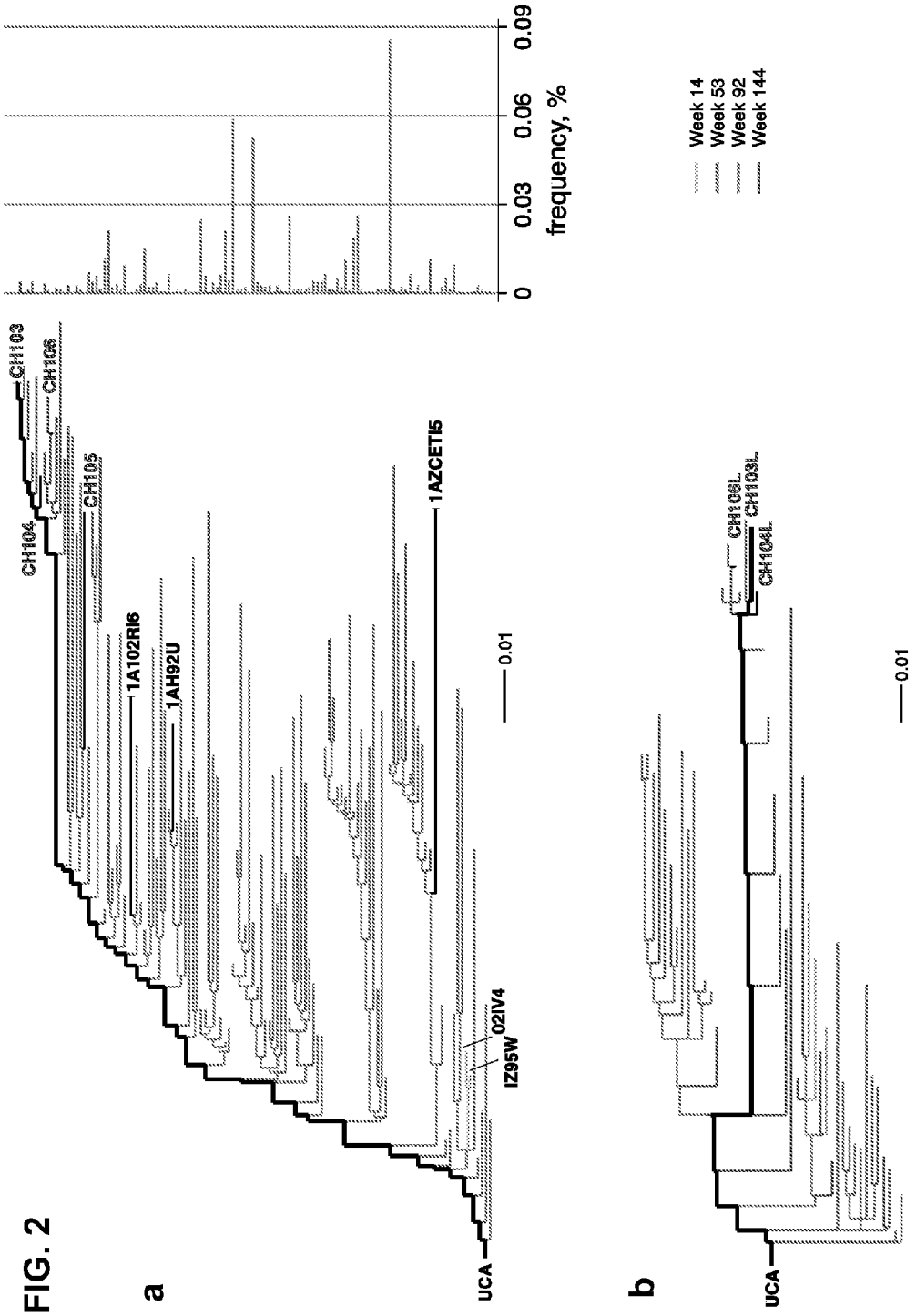
FIGS. 2A-2D. CH103-clonal family with time of appearance, $V_HDJ_H$ mutations, and HIV-1 Env reactivity. Phylogenies of $V_HDJ_H$ (FIG. 2A) and $V_LJ_L$ (FIG. 2B) sequences from sorted single memory B cells and pyrosequencing. Figure was produced using DNA sequences and the EBI bioinformatics server at www.ebi.ac.uk/Tools/phylogeny/ with ancestral reconstructions performed using dnaml maximum likelihood. Neighbor joining was used to illustrate the correspondence of sampling date and read abundance in the context of the clonal history. Within time-point $V_H$ monophyletic clades are collapsed to single branches; variant frequencies are indicated on the right. Isolated mature antibodies are red, pyrosequencing-derived sequences are black. The inferred evolutionary paths to observed matured antibodies are bold.
Figure 2:
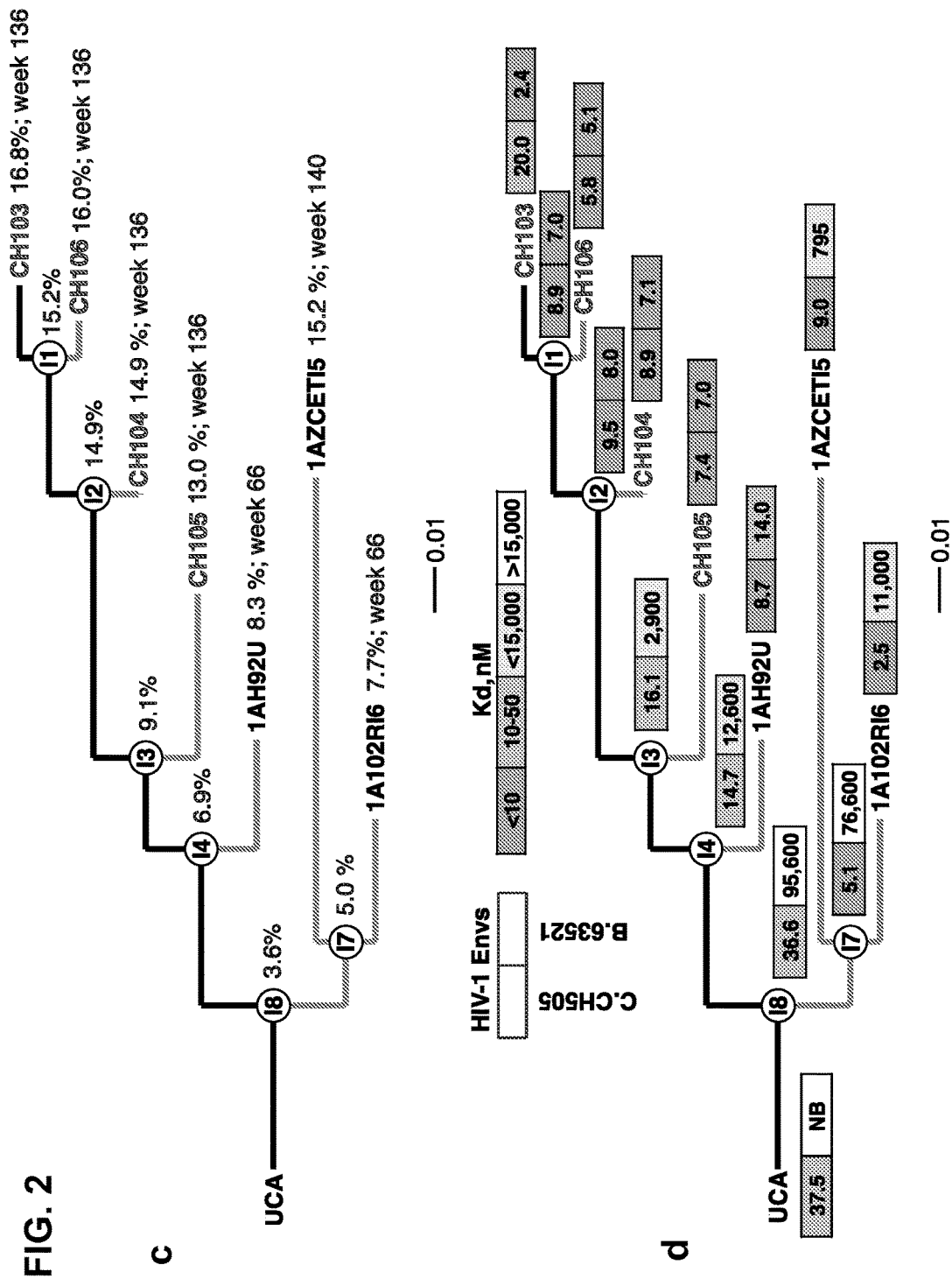

The third analysis performed was to compute the distance of each heavy chain sequences in the tree to its nearest neighbor. The mean distance to the nearest neighbor is 8.1 nt. Agglomerative clustering was used to prune the sequence alignment. At the stage where no pairs of sequences were 3 nucleotides apart or closer, there were 335 of 452 sequences remaining; when no pairs are 6nt apart or closer, there are still 288 sequences remaining. Therefore, with this analysis, it is believed that the number of genes represented in the sample is closer to 300 than to 50, and may be larger. Thus, by the sum of these re-analyses, it is believed that the number of genes in the trees in FIG. 2 are quite plausible.

The isolated Ig $V_HDJ_H$ and $V_LJ_L$ gene pairs, the inferred UCA and intermediate $V_HDJ_H$ and $V_LJ_L$ sequences, and select $V_HDJ_H$ gene sequences identified by pyrosequencing were studied experimentally (Table 2) and used to generate a phylogenetic tree showing percentage of mutated Vu sites and time of appearance after transmission (FIG. 2C) and binding affinity (FIG. 2D). The isolated four mature antibodies are indicated in red, antibodies derived from 454 pyrosequencing are indicated in black, and inferred-intermediate antibodies (I1-I4, I7, I8) are indicated by circles at ancestral nodes. The deep clades in this tree had modest bootstrap support, and the branching order and UCA inference were somewhat altered when more sequences were added to the phylogenetic analysis (compare the branching order of FIG. 2C and FIG. 2A). The tree depicted in FIGS. 2C and 2D was used to derive the ancestral intermediates of the representative lineage early in the study, and marked an important step in the analysis of antibody affinity maturation. The $V_HDJ_H$ and $V_LJ_L$ genes were synthesized (GenScript, NJ) and cloned into pcDNA3.1 plasmid (Invitrogen, Grand Island, N.Y.) for production of purified recombinant IgG1 antibodies as described previously (Liao et al, J. Virol. Methods 158:171-179 (2009), Liao et al, Immunity 38:176-186 (2013)). The $V_HDJ_H$ genes of I1-I4, I7 and I8 as well as the $V_HDJ_H$ of CH105 were paired with either the $V_L$ gene of the inferred UCA or I2 depending on the genetic distance of the $V_HDJ_H$ to either the UCA or mature antibodies for expressing as full-length IgG1 antibodies as described (Liao et al. J. Meth. Virol. 158:171-179 (2009)) (Table 2).

Production of Recombinant HIV-1 Proteins.

HIV-1 Env genes including subtype B, 63521, subtype C, 1086, and subtype CRF_0.01, 427299, as well as subtype C, CH505 autologous transmitted/founder Env were obtained from acutely infected HIV-1 subjects by single genome amplification (Keele et al, Proc. Natl. Acad. Sci. USA 105:7552-7557 (2008)) codon-optimized by employing the codon usage of highly expressed human housekeeping genes (Andre et at, Journal of Virology 72:1497-1503 (1998)), de novo synthesized (GeneScript, NJ) as gp140 or gp120 (AE.427299) and cloned into a mammalian expression plasmid pcDNA3.1/hygromycin (Invitrogen, Grand Island, N.Y.). Recombinant Env glycoproteins were produced in 293F cells cultured in serum-free medium and transfected with the HIV-1 gp140- or gp120-expressing pcDNA3.1 plasmids, purified from the supernatants of transfected 293F cells by using *Galanthus nivalis* lectin-agarose (Vector Labs, Burlingame, Calif.) column chromatography (Ma et al, PLoS Pathog. 7:e1002200 (2001)), Liao et al, Virology 353:268-282 (2006), Liao et al, Immunity 38:176-186 (2013)), and stored at −80° C. until use. Select Env made as CH505 T/F Env were further purified by superpose 6 column chromatography to trimer forms, and used in binding assays that showed similar results as with the lectin-purified oligomers.

Enzyme-Linked Immunoassay (ELISA).

Binding of patient plasma antibodies and CH103 clonal lineage antibody members to autologous and heterologous HIV-1 Envs was measured by ELISA as described previously (Liao et al, J. Exp. Med. 208:2237-2249 (2011), Liao et al, Immunity 38:176-186 (2013)). Plasma samples in serial 3-fold dilutions starting at 1:30 to 1:521,4470 or purified mAbs in serial 3-fold dilutions starting at 100 µg/ml to 0.000 µg/ml diluted in PBS were assayed for binding to autologous and heterologous HIV-1 Envs. Binding of biotin-labeled CH103 at the subsaturating concentration was assayed for cross competition by unlabeled HIV-1 antibodies and soluble CD4 in serial 4-fold dilutions starting at 10 µg/ml. The half maximal effective concentration (EC50) of plasma samples and mAbs to HIV-1 Envs were determined and expressed as either the reciprocal dilation of the plasma samples or concentration of mAbs.

Surface Plasmon Resonance (SPR) Affinity and Kinetics Measurements.

Binding $K_d$ and rate constant (association rate $k_a$, dissociation rate $k_d$) measurements of mAbs and all candidate UCAs to the autologous Env C. CH05 gp140 and/or the heterologous Env B.63521 gp120 were carried out on BIAcore 3000 instruments as described previously (Alam et al, J. Virol. 85:11725-11731 (2011), Alam et al, J. Immunol. 178:4424-4435 (2007), Alam et al, J. Virol. 82:115-125

(2008)). Anti-human IgG Fc antibody (Sigma Chemicals) was immobilized on a CM5 sensor chip to about 15000 Response Unit (RU) and each antibody was captured to about 50-200 RU on three individual flow cells for replicate analysis, in addition to having one flow cell captured with the control Synagis (anti-RSV) mAb on the same sensor chip. Double referencing for each mAb-HIV-1 Env binding interactions was used to subtract non-specific binding and signal drift of the Env proteins to the control surface and blank buffer flow respectively. Antibody capture level on the sensor surface was optimized for each mAb to minimize rebinding and any associated avidity effects. C.CH505 Env gp140 protein was injected at concentrations ranging from 2 to 25 μg/mL and B.63521 gp120 was injected at 50-400 μg/mL for UCA and early intermediates (IA8, IA4), 10-100 μg/mL (IA3), and 1-25 μg/mL for the distal and mature mAbs. All curve fitting analysis were performed using global fit of to the 1:1 Langmuir model and are representative of at least three measurements. All data analysis was performed using the BIAevaluation 4.1 analysis software (GE Healthcare).

Neutralization Assays.

Neutralizing antibody assays in TZM-bl cells were performed as described previously (Montefiori, The Journal of Infectious Diseases 206:431-441 (2012)). Neutralizing activity of plasma samples in 8 serial 3-fold dilutions starting at 1:20 dilution and for recombinant mAbs in 8 serial 3-fold dilutions starting at 50ug/ml were tested against autologous and herologous HIV-1 Env-pseudotyped viruses in TZM-bl-based neutralization assays using the methods as described (Wu et al, Science 329:856-861 (2010), Seaman et al, J. Virol. 84:1439-1452 (2010), Montefiori, The Journal of Infectious Diseases 206:431-441 (2012)). The data were calculated as a reduction in luminescence units compared with control wells and reported as IC50 in either reciprocal dilution for plasma samples or in μg/ml for mAbs.

Crystallization of Antibody CH103 and its Gp120 Complex.

The antigen binding fragment (Fab) of CH103 was generated by LyS-C(Roche) digestion of IgG1 CH103 and purified with protocols described previously (Zhou et al, Science 329:811-817 (2010)). The extended core gp120 of HIV-1 clade C ZM176.66 was used to form complex with Fab CH103. Briefly, deglycosylated ZM176.66 extended core gp120 that was produced using the method as described previously (Zhou et at, Science 329:811-817 (2010)) and Fab CH103 were mixed at a 1:1.2 molar ratio at room temperature and purified by size exclusion chromatography (Hiload 26/60 Superdex S200 prep grade, GE Healthcare) with buffer containing 0.35 M NaCl, 2.5 mM Tris pH 7.0, 0.02% NaN$_3$. Fractions of the Fab or gp120:CH103 complex were concentrated to ~10 mg/ml, flash frozen with liquid nitrogen before storing at ~80° C. and used for crystallization screening experiments.

Commercially available screens, Hampton Crystal Screen (Hampton Research), Precipitant Synergy Screen (Emerald BioSystems), Wizard Screen (Emerald BioSystems), PACT Suite and JCSG+ (Qiagen) were used for initial crystallization screening of both Fab CH1103 and its gp120 complex. Vapor-diffusion sitting drops were set up robotically by mixing 0.2 μl of protein with an equal volume of precipitant solutions (Honeybee 963, DigiLab). The screen plates were stored at 20° C. and imaged at scheduled times with RockImager (Formulatrix.). The Fab CH103 crystals appeared in a condition from the JCSG+ kit containing 170 mM ammonium sulfate, 15% glycerol and 25.5% PEG 4000. For the gp120:CH103 complex, crystals were obtained after 21 days of incubation in a fungi-contaminated droplet of the PACT suite that contained 200 mM sodium formate, 20% PEG 3350 and 100 mM Bistrispropane, pH 7.5.

X-Ray Data Collection, Structure Determination and Refinement for the gp120:CH103 Complex.

Diffraction data were collected under cryogenic conditions. Best cryo-protectant conditions were obtained by screening several commonly used cryo-protectants as described previously (Zhou et al, Science 329:811-817 (2010)). X-ray diffraction data were collected at beam-line ID-22 (SER-CAT) at the Advanced Photon Source, Argonne National Laboratory, with 1.0000 Å radiation, processed and reduced with HKL2000 (Otwinowski, Methods in Enzymology 276:307 (1997)). For the Fab CH103 crystal, a data set at 1.65 Å resolution was collected with a cryo-solution containing 20% ethylene glycol, 300 mM ammonium sulfate, 15% glycerol and 25% PEG 4000 (Table 7). For the gp120:CH103 crystals, a data set at 3.20 Å resolution was collected using a cryo-solution containing 30% glycerol, 200 mM sodium formate, 30% PEG 3350 and 100 mM Bistrispropane, pH 7.5 (Table 7).

The Fab CH103 crystal was in the P2$_1$ space group with cell dimensions at a=43.0, b=146.4, c=66.3, α=90.0, β=97.7, γ=90.0 and contained two Fab molecules per asymmetric unit (Table 7). The crystal structures of Fab CH103 were solved by molecular replacement using Phaser (McCoy et al, J. Appl. Crystallogr. 40:658-674 (2007)) in the CCP4 Program Suite (Project, eta Crystallographica Section D 50:760 (1994)) with published antibody structures as searching models. The gp120:CH103 crystal also belonged to the P2$_1$ space group with cell dimensions at a=48.9, b=208.7, c=69.4, α=90, β=107.2, γ=90.0, and contained two gp120:CH103 complexes per asymmetric unit (Table 7). The high resolution Fab CH103 structure was used as an initial model to place the Fab CH103 component in the complex. With the Fab CH103 position fixed, searching with the extended core Sp120 of ZM176.66 in the VRC01-bound form as an initial model failed to place the gp120 component in the complex. After trimming the inner domain and bridging sheet from the gp120 model, Phaser was able to correctly place the remaining outer domain of gp120 into the complex without significant clashes. Analysis of the packing of the crystallographic lattice indicated the lack of space to accommodate the inner domain of gp120, suggesting possible protease cleavage of the gp120 by the containing fungi during crystallization.

Structural refinements were carried out with PHENIX (Adams et al, Acta Crystallogr. D. Biol. Crystallogr. 58:1948-1954 (2002)). Starting with torsion-angle simulated annealing with slow cooling, iterative manual model building was carried out on COOT (Emsley and Cowtan, Acta Crystallogr. D. Biol. Crystallogr. 60:2126-2132 (2004)) with maps generated from combinations of standard positional, individual B-factor, TLS refinement algorithms and non-crystallographic symmetry (NCS) restraints. Ordered solvents were added during each macro cycle. Throughout the refinement processes, a cross validation (R$_{free}$) test set consisting of 5% of the data was used and hydrogens were included as riding model. Structure validations were performed periodically during the model building/refinement process with MolProbity (Davis et al, Nucleic Acids Res. 35:W375-383 (2007)) and pdb-care (Lutteke and von der Lieth, BMC Bioinformatics 5:69 (2004)). X-ray crystallographic data and refinement statistics are summarized in Table 7. The Kabat nomenclature (Kabat et l, C. Sequences of Proteins of Immunological Interest, 5$^{th}$ Edition (1991)) was used for numbering of amino acid residues in amino acid sequences in antibodies.

Protein Structure Analysis and Graphical Representations.

PISA (Krissinel and Henrick, J. Mol. Biol. 372:774-797 (2007)) was used to perform protein-protein interfaces analysis. CCP4 (Emsley and Cowtan, Acta Crystallogr. D. Biol. Crystallogr. 60:2126-2132 (2004)) was used for structural alignments. All graphical representation with protein crystal structures were made with Pymol (DeLano, The PyMOL Molecular Graphics System, DeLano Scientific, San Carlos, Calif., USA www.pymol. Org (2002)).

Polyreactivity Analysis of CH103 Clonal Lineage Antibodies by HEp-2 Cell Staining, ANA Assays and Protein Array Microchip.

All antibodies in CH103 clonal lineage were assayed at 50 µg/ml for autoreactivity to HEp-2 cells (Inverness Medical Professional Diagnostics, Princeton, N.J.) by indirect immunofluorescence staining and a panel of autogens by ANA assays using the methods as reported previously (Haynes et al, Science 308:1906-1908 (2005)). The intermediate antibody (IA1) and CH106 were identified as reactive with HEp-2 cells and then selected for further testing for reactivity with human host cellular antigens using ProtoArray 5 microchip (Invitrogen, Grand Island, N.Y.) according to the instructions of the microchip manufacturer. Briefly, ProtoArray 5 microchips were blocked and exposed to 2 µg/ml IA1, CH106 or an isotype-matched (IgG1, k) human myeloma protein, 151K (Southern Biotech) for 90 min at 4° C. Protein-Ab interactions were detected by 1 µg/mL Alexa Fluor 647-conjugated anti-human IgG. The arrays were scanned at 635 nm with 10 µm resolution using 100% power and 600 gain (GenePix 4000B scanner, Molecular Devices). Fluorescence intensities were quantified using GenePix Pro 5.0 (Molecular Devices). Lot-specific protein spot definitions were provided by the microchip manufacturer and aligned to the image.

Results

Isolation of the CH103 BnAb Lineage

Figure 1:
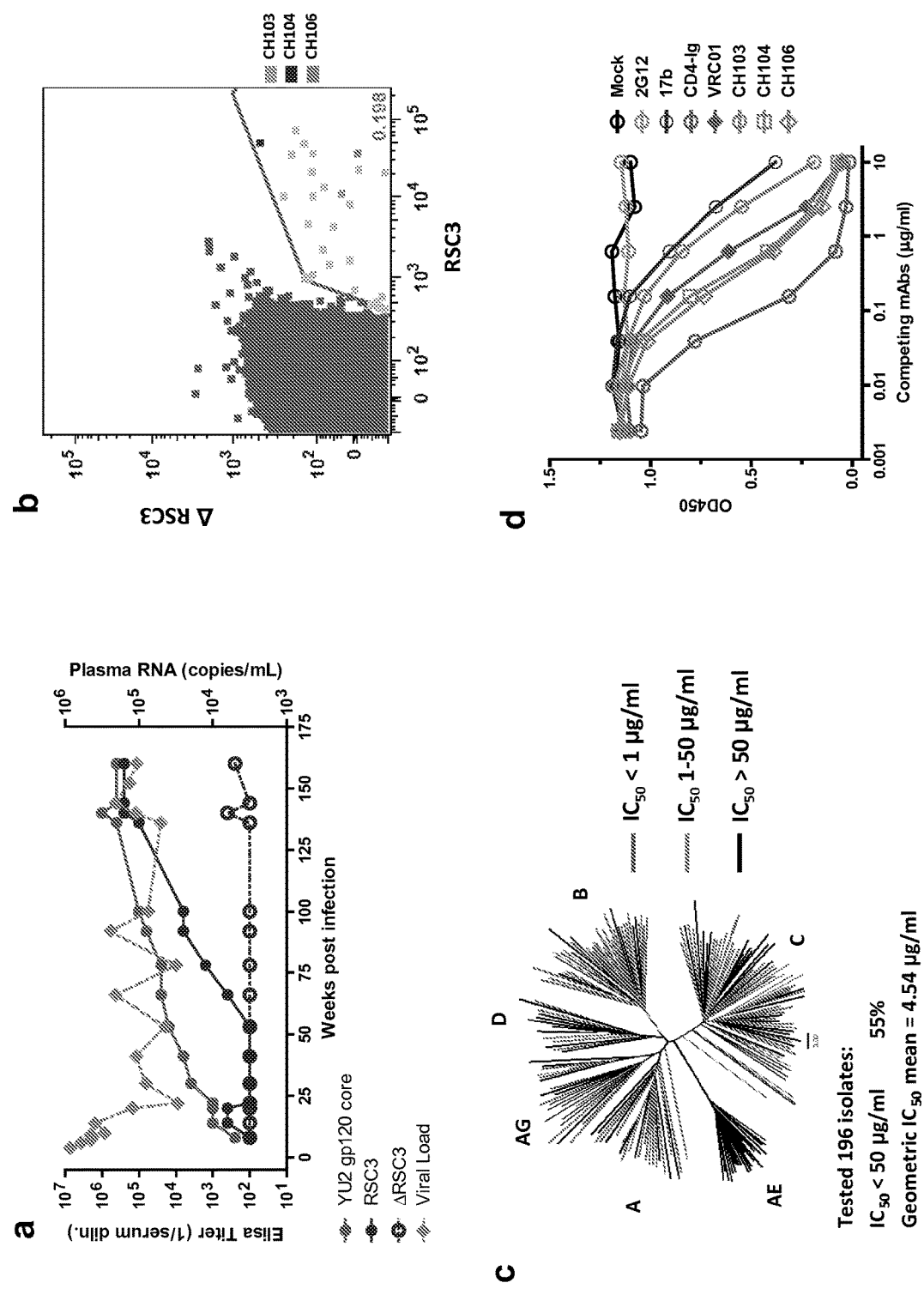
FIGS. 1A-1D. Development of neutralization breadth in donor CH505 and isolation of antibody.

The CH505 donor was enrolled in the CHAVI001 acute HIV-1 infection cohort (Tomaras et al, J. Virol. 82:12449-12463 (2008)) approximately 4 weeks after HIV-1 infection (FIG. 7) and followed for more than 3 years. Single genome amplification of 53 plasma viral Env gp160 RNAs (5) from 4 weeks after transmission identified a single clade C transmitted/founder (T/F) virus. Serologic analysis demonstrated the development of autologous neutralizing antibodies at 14 weeks, CD4 binding site (CD4bs) antibodies that bound to a recombinant Env protein (resurfaced core, RSC3) (Wu et al, Science 329:856-861 (2010)) at 53 weeks, and evolution of plasma cross-reactive neutralizing activity from 41-92 weeks after transmission (Lynch et al, J. Virol. 86:7588-7595 (2012)) (FIG. 1, Table 1, FIG. 8). The natural variable regions of heavy-($V_H DJ_H$) and light-chain ($V_L J_L$) gene pairs of antibodies CH103, CH104, CH106 were isolated from peripheral blood mononuclear cells (PBMC) at 136 weeks after transmission by flow sorting of memory B cells that bound RSC3 Env protein (Scheid et al, J. Immunol. Methods 343:65-67 (2009), Wu et al, Science 329:856-861 (2010), (Scheid et al, Nature 458:636-640 (2009)) (FIG. 1B). The $V_H DJ_H$ gene of antibody CH105 was similarly isolated, but no $V_L J_L$ gene was identified from the same cell. Analysis of characteristics of $V_H DJ_H$ ($V_H 4$-59 [posterior probability, PP=0.99], D3-16 (PP=0.74), $J_H 4$ [PP=1.00]) and $V_L J_L$ (Vλ3-1 [PP=1.00], Jλ1 [PP=1.00]) rearrangements in mAbs CH103, CH104, CH105 and CH106 demonstrated that these antibodies were representatives of a single clonal lineage designated as the CH103 clonal lineage (FIG. 2, Table 2).

Neutralization assays using a previously described (Wu et al, Science 329:856-861 (2010), (Seaman et al, J. Virol. 84:1439-1452 (2010)) panel of 196 of geographically and genetically diverse Env-pseudoviruses representing the major circulated genetic subtypes and circulating recombinant forms demonstrated that CH103 neutralized 55% of viral isolates with a geometric mean $IC_{50}$ of 4.54 ug/ml among sensitive isolates (FIG. 1C, Table 3). ELISA cross-competition analysis demonstrated that CH103 binding to gp120 was competed by known CD4bs ligands such as mAb VRC01 and the chimeric protein CD4-Ig (FIG. 1D); CH103 binding to RSC3 Env was also substantially diminished by gp120 with P363N and Δ371I mutations known to reduce binding of most CD4bs mAbs (FIG. 9) (Wu et al, Science 329:856-861 (2010), Lynch et al, J. Virol. 86:7588-7595 (2012)).

Molecular Characterization of the CH103 BnAb Lineage

The RSC3 probe isolated CH103, CH104, CH105, and CH106 BnAbs by single cell flow sorting. The CH103 clonal lineage was enriched by $V_H DJ_H$ and $V_L J_L$ sequences identified by pyrosequencing PBMC DNA (Liao et al, J. Exp. Med. 208:2237-2249 (2011), Boyd et al, Sci. Transl. Med. 1:12ra23 (2009)) obtained 66 and 140 weeks after transmission and cDNA antibody transcripts (Wu et al, Science 333:1593-1602 (2011)) obtained 6, 14, 53, 92 and 144 weeks after transmission. From pyrosequencing of antibody gene transcripts, 457 unique heavy and 171 unique light chain clonal members were found (FIGS. 2A, 2B). For comprehensive study, a representative 14 member BnAb pathway was reconstructed from $V_H DJ_H$ sequences (1AH92U, 1AZCET and 1A102R) recovered by pyrosequencing, and $V_H DJ_H$ genes of the inferred intermediate (I) antibodies (I1-I4, I7, I8) (Haynes et al, Nat. Biotechnol. 30:423-433 (2012), (Ma et al, PLoS Pathog. 7:e1002200 (2001)), Liao et al, J. Exp. Med. 208:2237-2249 (2011)) (Kepler, T B, Submitted, 2012) that were paired and expressed with either the UCA or I2 $V_L J_L$ depending on the genetic distance of the $V_H DJ_H$ to either the UCA or mature antibodies (FIG. 2C, Table 2). The mature CH103, CH104 and CH106 antibodies were paired with their natural $V_L J_L$. The CH105 natural $V_H D_H J_H$ isolated from RSC3 memory B cell sorting was paired with the $V_L J_L$ of I2.

Whereas the $V_H DJ_H$ mutation frequencies of the published CD4bs BnAbs VRC01, CH31 and NIH45-46 $V_H DJ_H$ are 30-36% (Wu et al, Science 329:856-861 (2010), Wu et al, Science 333:1593-1602 (2011), Zhou et al, Science 329:811-817 (2010), Scheid et al, Science 333:1633-1637 (2011), (Bonsignori et al, J. Virol. 86:4688-4692 (2012)), the CH103 lineage CH103, CH104, CH105 and CH106 $V_H DJ_H$ frequencies are 13-17% (FIG. 2C). Additionally, antibodies in CH103 clonal lineage do not contain the large (>3 nt) insertion or deletion mutations common in VRC01-class of BnAbs (1-3) with the exception of the $V_L J_L$ of CH103 which contained a 3 as LCDR1 deletion.

It has been proposed that one reason CD4bs BnAbs are difficult to induce is heterologous HIV-1 Envs do not bind their UCAs (Zhou et al, Science 329:811-817 (2010), Xiao et al, Biochem. Biophys. Res. Commun. 390:404-409 (2009)), Scheid et al, Science 333:1633-1637 (2011)). The question presented was whether the CH505 T/F Env, the initial driving antigen for the CH103 BnAb lineage, would preferentially bind to early CH103 clonal lineage members and the UCA compared to heterologous Envs. Indeed, a heterologous gp120 T/F Env, B.63521, did not bind to the CH103 UCA (FIG. 2D) but did bind to later members of the clonal lineage. Affinity for this heterologous Env increased four orders of magnitude during somatic evolution of the CH103 lineage, with maximal $K_d$ values of 2.4 to 7.0 nM in the mature CH103-CH106 mAbs (FIG. 2D). The CH103 UCA mAb also did not bind other heterologous T/F Envs AE.427299, B.9021 and C.1086 (Table 4), confirming lack of heterologous Env binding to CD4bs UCAs. Moreover, the gp120 Env RSC3 protein was also not bound by the CH103 UCA and earlier members of the clonal lineage (FIG. 9A) and no binding was seen with RSC3 mutant proteins known to disrupt CD4bs BnAb binding (FIG. 9B).

In contrast to heterologous Envs, the CH505 T/F Env gp140 bound well to all of the candidate UCAs (Table 5) with the highest UCA affinity of $K_d$=37.5 nM. In addition, the CH505 T/F Env gp140 was recognized by all members of the CH103 clonal lineage (FIG. 2D). Whereas affinity to the heterologous T/F Env B.63521 increased by over four orders of magnitude as the CH103 lineage matured, affinity for the CH505 T/F Env increased by no more than ten fold (FIG. 2D). To directly demonstrate Env escape from CH103 lineage members, autologous recombinant gp140 Envs isolated at weeks 30, 53 and 78 postinfection were expressed and compared with the CH505 T/F Env for binding to the BnAb arm of the CH103 clonal lineage (Table 6, FIG. 10). Escape mutant Envs could be isolated that were progressively less reactive with the CH103 clonal lineage members. Envs isolated from weeks 30, 53 and 78 lost UCA reactivity and only bound intermediate antibodies 3, 2 and 1 as well as BnAbs CH103, CH104, CH105 and CH106 (Table 6). In addition, two Env escape mutants from week-78 viruses also lost either strong reactivity to all intermediate antibodies or to all lineage members (Table 6).

To quantify CH103 clonal variants from initial generation to induction of broad and potent neutralization, pyrosequencing of antibody cDNA transcripts from five time points, weeks 6, 14, 53, 92 and 144 weeks after transmission was used (Table 7). Two $V_HDJ_H$ chains closely related to, and possibly members of, the CH103 clonal lineage were found (FIG. 2A, Table 7). Moreover, one of these $V_HDJ_H$ when reconstituted in a full IgG1 backbone and expressed with the UCA $V_LJ_L$ weakly bound the CH505 T/F Env gp140 at endpoint titer of 11 μg/ml (FIG. 2A). These reconstituted antibodies were present concomitant with CH505 plasma autologous neutralizing activity at 14 weeks after transmission (FIG. 8). Antibodies that bound the CH505 T/F Env were present in plasma as early as 4 weeks after transmission (data not shown). Both CH103 lineage $V_HDJ_H$ and $V_LJ_L$ sequences peaked at week 53 with 230 and 83 unique transcripts, respectively. $V_HDJ_H$ clonal members fell to 46 at week 144, and $V_LJ_L$ members were 76 at week 144.

Polyreactivity is a common trait of BnAbs, suggesting that the generation of some BnAbs may be controlled by tolerance mechanisms (Haynes et al, Science 308:1906-1908 (2005), Mouquet et al, Nature 467:591-595 (2010), Haynes et al, Hum. Antibodies 14:59-67 (2005)). Conversely, polyreactivity can arise during the somatic evolution of B cells in germinal centers as a normal component of B-cell development (Wardemann et al, Science 301:1374-1377 (2003)). The CH103 clonal lineage was evaluated for polyreactivity as measured by HEp-2 cell reactivity and binding to a panel of autoantigens (Haynes et al, Science 308:1906-1908 (2005)). While earlier members of the CH103 clonal lineage were not polyreactive by these measures, polyreactivity was acquired in concert with BnAb activity by the intermediate antibody I2, I1, and clonal members, CH103, CH104 and CH106 (FIGS. 11A, 11B).

The BnAbs CH106 and intermediate antibody I1 also demonstrated polyreactivity in protein arrays with specific reactivity to several human autoantigens, including elongation factor-2 kinase and ubiquitin-protein ligase E3A (FIGS. 11C and 11D).

Structure of CH103 in Complex with HIV-1 gp120

Figure 3:
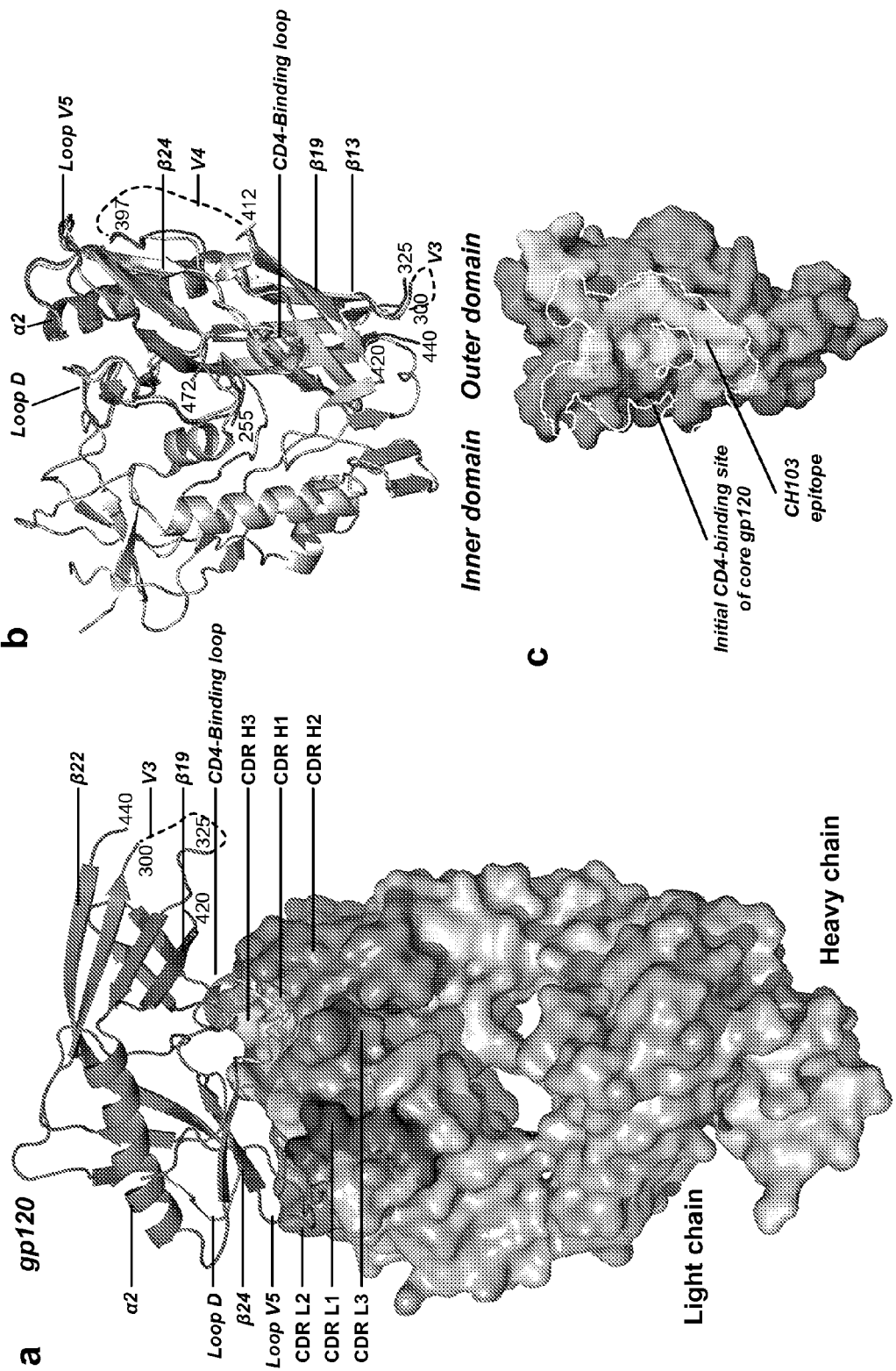
FIGS. 3A-3D. Structure of antibody CH103 in complex with the outer domain of HIV-1 gp120 (OD).
Figure 3:
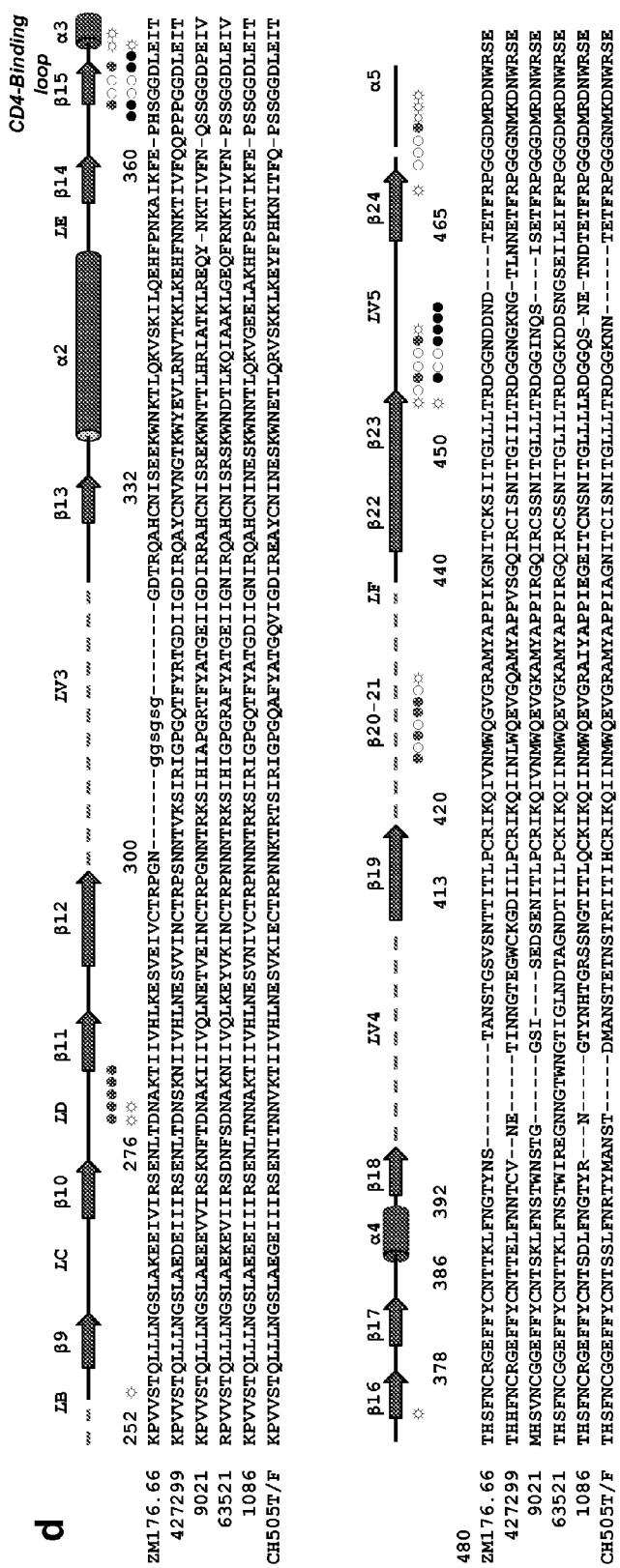

Crystals of the complex between Fab CH103 and the ZM176.66 strain of HIV diffracted to 3.15-Å resolution, and molecular replacement identified solutions for Fab CH103 and for the outer domain of gp120 (FIG. 3A). Inspection of the CH103-gp120 crystal lattice (FIG. 12) indicated the absence of the gp120 inner domain was likely related to proteolytic degradation of the extended gp120 core to an outer domain fragment. Refinement to $R_{crystal}/R_{free}$ of 19.1%/25.3% (Table 8) confirmed a lack of electron density for gp120 residues N terminal to residue Val $255_{gp120}$ or C terminal to Gly$472_{gp120}$ (gp120 residues are numbered according to standard HXB2 nomenclature), and no electron density was observed for residues 301-324$_{gp120}$ (V3), 398-411$_{gp120}$ (V4) and 421-439$_{gp120}$ (β20-21). Superposition of the ordered portions of gp120 (gp120 residues are numbered according to standard HXB2 nomenclature) in complex with CH103 with the fully extended core gp120 bound by antibody VRC01 (Zhou et al, Science 329:811-817 (2010)) indicated a highly similar structure (Cα-rmsd 1.16 Å) (FIG. 3B). Despite missing portions of core gp120, the entire CH103 epitope appeared to be present in the electron density for the experimentally observed gp120 outer domain.

The surface bound by CH103 formed an elongated patch with dimensions of ~40×10 Å, which stretched across the site of initial CD4 contact on the outer domain of gp120 (FIG. 3C). The gp120 surface recognized by CH103 correlated well with the initial site of CD4 contact; of the residues contacted by CH103, only eight of these residues were not predicted to interact with CD4. CH103 interacted with these residues through side-chain contact with Ser$256_{gp120}$ in loop D, main- and side-chain contacts with His$364_{gp120}$ and Leu$369_{gp120}$ in the CD4-binding loop, and main- and side-chain contacts with Asn$463_{gp120}$ and Asp$464_{gp120}$ in the V5 loop (FIG. 3D). Notably, residue 463 is a predicted site of N-linked glycosylation in strain ZM176.66 as well as in the autologous CH505 virus, but electron density for an N-linked glycan was not observed. Overall, of the 22 residues that mAb CH103 was observed to contact on gp120, 14 were expected to interact with CD4 (16 of these residues with antibody VRC01), providing a structural basis for the CD4-epitope specificity of CH103 and its broad recognition (Table 9).

Figure 4D:
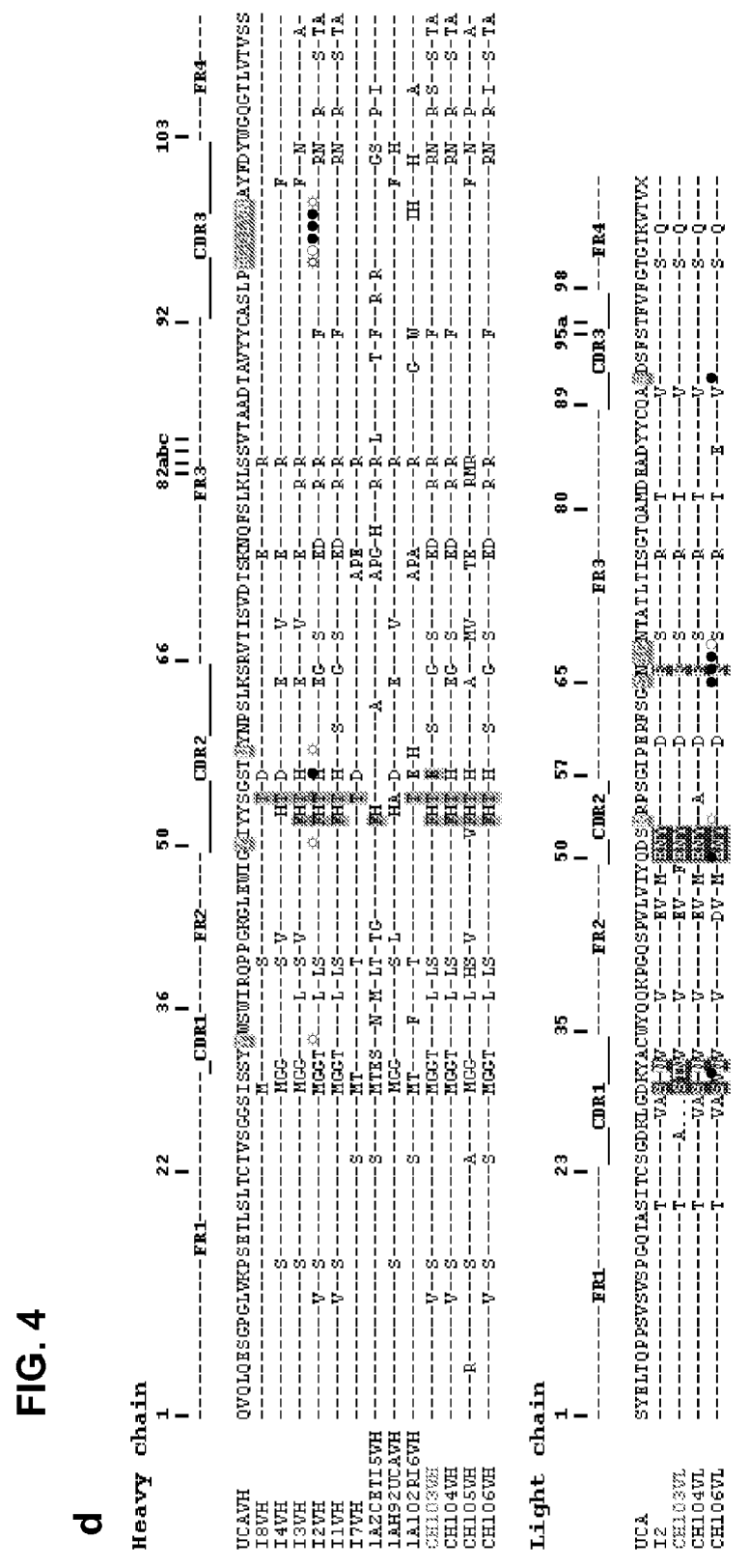

Residues 1-215$_{HC}$ on the antibody heavy chain and 1-209$_{LC}$ showed well defined backbone densities. Overall, CH103 utilizes a CDR H3 dominated mode of interaction, although all six of the complementarity-determining regions (CDRs) interacted with gp120 as well as the light chain framework region 3 (FWR3) (FIG. 4A,B, Tables 10 and 11). It is important to note that ~40% of the antibody contact surface was altered by somatic mutation, in two regions, in the CDR H2 and in the CDR L1, L2 and FWR3. In particular, residues 56$_{HC}$, 50$_{LC}$, 51$_{LC}$ and 66$_{LC}$ are altered by somatic mutation to form hydrogen bonds with the CD4-binding loop, loop D and loop V5 of gp120. Nevertheless, 88% of the CH103 $V_HD_HJ_H$ and 44% of the VλJλ contact areas were with amino acids unmutated in the CH103 germline, potentially providing an explanation for the robust binding of the T/F Env to the CH1103 UCA (FIGS. 4C, 4D, and Table 12).

Evolution of Transmitted/Founder Env Sequences Tracks Acquisition of BnAb Activity Using single genome amplification and sequencing ((Keele et al, Proc. Natl. Acad. Sci. USA 105:7552-7557 (2008)), the evolution of CH505 env genes was tracked longitudinally from the T/F virus through 160 weeks post-transmission (FIG. 5, FIG. 12). The earliest recurrent mutation in Env, N279K (HIV-1 HXB2 numbering), was found at 4 weeks post-infection, and was in Env loop D in a CH103 contact residue. By week 14 additional mutations in loop D appeared, followed by mutations and insertions in V1 at week 20. Insertions and mutations in the V5 loop began to accumulate by week 30 (FIG. 5). Thus, the T/F virus began to diversify in key CD4 contact regions starting within 3 months of infection (FIGS. 13, 14). Loop D and V5 mutations were directly in or adjacent to CH103/Env contact residues. Although the V1 region was not included in the CH103-Env co-crystal, the observed V1 CH505 Env mutations were adjacent to contact residues for CD4 and VRC01 so are likely to be relevant. It is also possible that early V1 insertions (FIG. 5) were selected by inhibiting access to the CD4bs in the trimer or that they arose in response to early T cell pressure. CD4 binding-loop mutations were present by week 78. Once regions that could directly impact CH103-lineage binding began to evolve (loop D, V5, the CD4 binding, loop, and possibly V1), they were under sustained positive selective pressure throughout the study period (FIG. 5, FIGS. 13, 14, Table 13).

Considerable within-sample virus variability was evident in Env regions that could impact CH103-linage antibody binding, and diversification within these regions preceded neutralization breadth. Expanding diversification early in viral evolution (4-22 weeks after transmission) (FIGS. 13, 14) coincided with autologous NAbs development, consistent with autologous NAb escape mutations. Mutations that accumulated from weeks 41-78 in CH505 Env contact regions immediately preceded development of NAb breadth (FIG. 5, FIGS. 13, 14). By weeks 30-53, extensive within-sample diversity resulted from both point mutations in and around CH103 contact residues, and to multiple insertions and deletions in V1 and V5 (FIG. 14). A strong selective pressure seems to have come into play between weeks 30 and 53, perhaps due to autologous neutralization escape, and neutralization breadth developed after this point (FIGS. 5, 13, 14). Importantly, due to apparent strong positive selective pressure between week 30 and week 53, there was a dramatic shift in the viral population that is evident in the phylogenetic tree, such that only viruses carrying multiple mutations relative to the T/F, particularly in CH103 contact regions, persisted after week 30. This was followed by extreme and increasing within time-point diversification in key epitope regions, beginning at week 53 (FIG. 14). Emergence of antibodies with neutralization breadth occurred during this time (FIG. 8, Table 1). Thus, plasma breadth evolved in the presence of highly diverse forms of the CH103 epitope contact regions (FIG. 5, FIG. 8).

To evaluate and compare the immune pressure on amino acids in the region of CH103 and CD4 contacts, a comparison was made of the frequency of mutations in evolving T/F sequences of patient CH505 during the first year of infection and in 16 other acutely infected subjects followed over time (FIG. 15). The accumulation of mutations in the CH505 virus population was concentrated in regions likely to be associated with escape from the CH103 lineage (FIG. 15A), and diversification of these regions was far more extensive during the first six months of infection in CH505 than in other subjects (FIG. 15B). However, by one year into their infections, viruses from the other subjects had also begun to acquire mutations in these regions. Thus, the early and continuing accumulation of mutations in CH103 contact regions may have potentiated the early development of neutralizing antibody breadth in patient CH505.

Neutralization of Autologous and Heterologous Viruses and the CH103 Lineage

Figure 6:
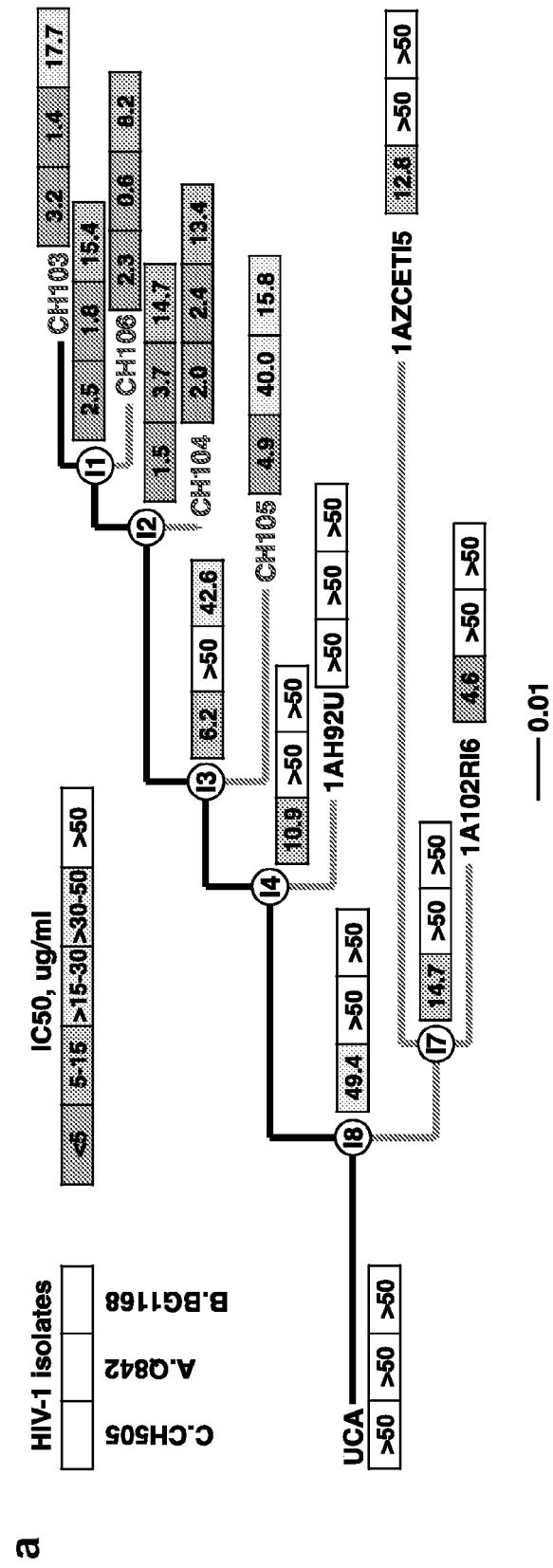
FIGS. 6A and 6B. Development of neutralization breadth in the CH103-clonal lineage.
Figure 6:
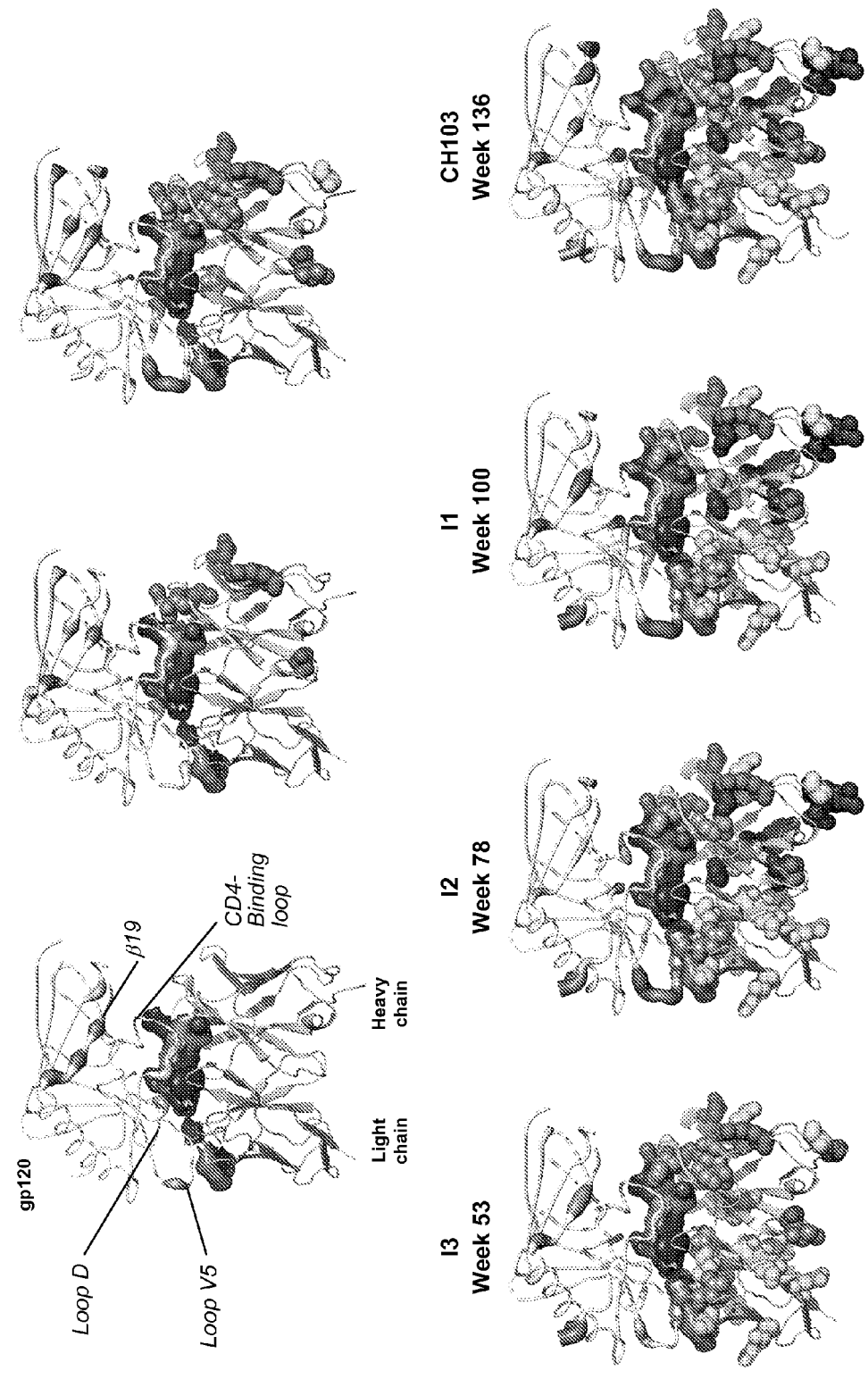
Figure 16:
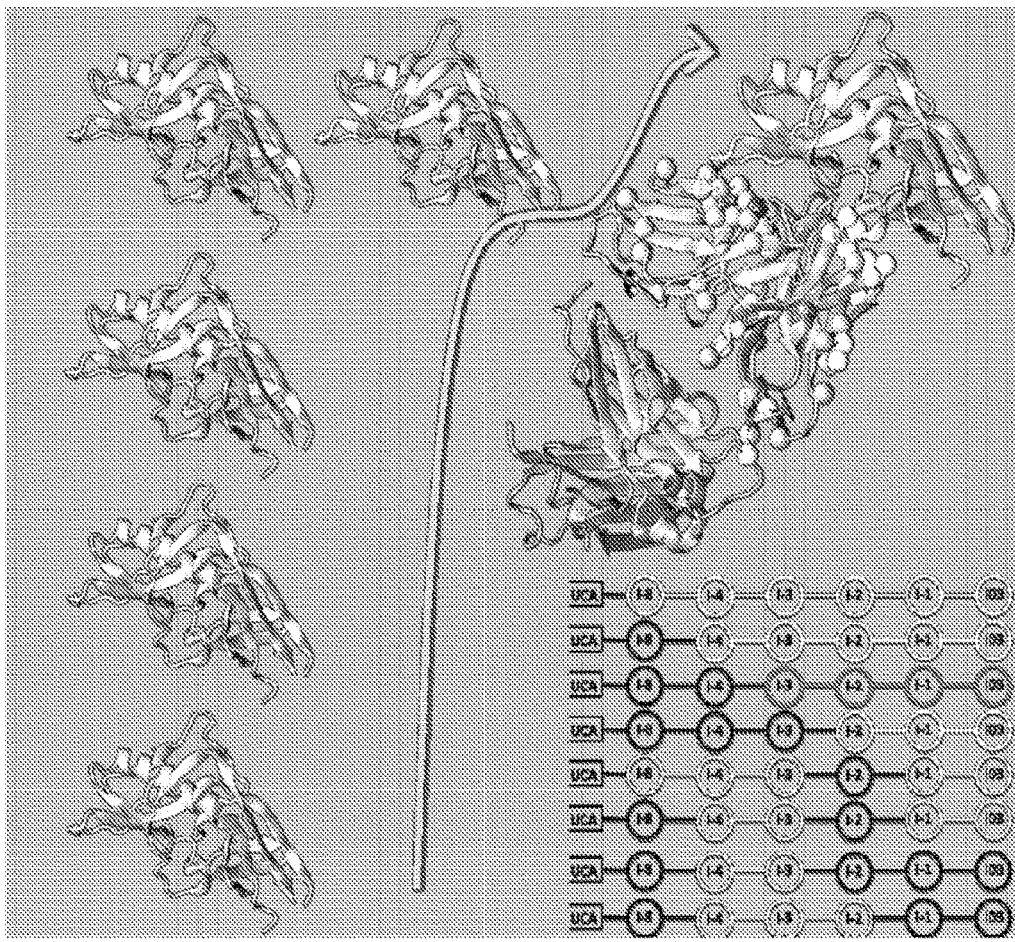
FIG. 16. Co-evolution of virus and antibody—interplay between maturation of antibody CH103 and sequence variability epitope in gp120. The sequence variability (within sample) at each time point is mapped on a gp120 structure that tracks the viral evolution over time from 14 weeks thru 100 weeks post-transmission. Entropy at each residue is color-coded as green to white to red to indicate no sequence variation to slight variation to high sequence variation. This extensive virus within-time point diversity coincides with maturing antibody lineages that ultimately develop breadth. Here, the somatic mutations are captured along the CH103 clonal lineage beginning with unmutated common ancestor (UCA) to I-8 to I-4 to I-3 to I-2 to I-1 and to mature CH103. The color balls in heavy (violet) and light (cyan) chains of antibody indicate the appearance/disappearance of somatic mutations during the evolutionary path according to the following scheme. Red balls: mutations appeared in I-8 and remained all the way thru maturation to CH103, Orange balls: mutations appeared in I-4 and remained thru maturation to CH103, Blue balls: mutations that appeared early but are lost before maturing to CH103, and Gray balls: mutations that appeared very late in maturation. Structure of Fab CH103-gp120 from ZM176.66 complex determined in this work is used to map these mutations. The sequence entropy at week 100 is used to pair with CH103 to simply illustrate the relative spatial locations of somatic mutations and sequence variability in gp120. As discussed in the text, viral evolution with time tracks with neutralization breadth and this simple mapping supports that (i) T/F virus began to diversify very early in regions in or proximal to the epitope, and (ii) Somatic mutations that occur early in evolution and remain fixed in heavy chain tend to cluster near the gp120 contact region unlike those mutations that appear later.

Heterologous BnAb activity was confined to the later members (I3 and later) of the BnAb arm of the CH03 lineage as manifested by their neutralization capacity of pseudoviruses carrying tier 2 Envs A.Q842 and B.BG1168 (FIG. 6A). Similar results were seen with Envs A.Q168, B.JRFL, B.SF162 and C.ZM106 (Tables 14 and 15). In contrast, neutralizing activity of clonal lineage members against the autologous T/F Env pseudovirus appeared earlier with measurable neutralization of the CH505 T/F virus by all members of the lineage after the UCA except mAb 1AH92U (FIG. 6A). Thus, within the CH103 lineage, early intermediate antibodies neutralized the T/F virus, while later intermediate antibodies gained neutralization breadth, indicating evolution of neutralization breadth with affinity maturation, and CH103-CH106 BaAbs evolved from an early autologous neutralizing antibody response. Moreover, the clonal lineage was heterogeneous, with an arm of the lineage represented in FIG. 6A evolving neutralization breadth and another antibody arm capable of mediating only autologous T/F virus neutralization. While some escape viruses are clearly emerging over time (Table 4), it is important to point out that, whereas escape mutant viruses are driving BnAb evolution, the BnAbs remain capable of neutralizing the CH505 T/F virus (FIG. 6A). Of note, the earliest mutations in the heavy chain lineage clustered near the contact points with gp120, and these remained fixed throughout the period of study, while mutations that accumulated later tended to be further from the binding site and may be impacting binding less directly (FIG. 10). Thus, stimulation of the CH103 BnAbs occurs in a manner to retain reactivity with the core CD4bs epitope present on the T/F Env. One possibility that might explain this is that the footprint of UCA binding contracts to the central core binding site of the CH103 mature antibody. Obtaining a crystal structure of the UCA with the T/F Env should inform this notion. Another possibility is that because affinity maturation is occurring in the presence of highly diverse forms of the CD4bs epitope, antibodies that favor tolerance of variation in and near the epitope are selected instead of those antibodies that acquire increased affinity for particular escape Envs. In both scenarios, persistence of activity to the T/F form and early viral variants would be expected. FIG. 6B and FIG. 16 show views of accumulations of mutations or entropy during the parallel evolution of the antibody paratope and the Env epitope bound by mAb CH103.

Example 2

Shown in FIG. 19 are CH505 Env sequences for a multivalent-valent vaccine that can be made both with RNAs (Geall et al, Proc. Natl. Acad. Sci. 109: 14604-14609 (2012)) and DNAs (Ledgerwood, et al. Clin Vaccine Immunol. 19:1792-7 (2012)) as gp160s for genetic immunization and as well made as gp160s and gp140s (Liao et al, Nature 201: 469-76 (2013)) for poxvirus vector immunizations in ALVAC (canary pox) vectors such as was used in RV144 (Rerks-Ngarm et al. NEJM 361:2209-2220 (2009)) and NYVAC that either are replicating (such as NYVAC-KC, Kibler et al, PLoS One 6: e25674, Epub 2011, Nov. 9) or non-replicating (such as NYVAC-C, Perreau et al, J. Virol. 85: 9854-62 (2011)). Criteria for choosing the Envs was based on the following criteria: (i) the expressed Envs optimally bound to members of the CH103 BnAb lineage, or (ii) the viruses with these Envs escaped the CH103 lineage and, therefore, were involved in its early stimulation, or (iii) the viruses with these Envs did not escape from the CH103 lineage and, therefore, were able to continue to stimulate the later stages of the CH103 lineage, or (iv) the viruses with these Envs were hypersensitive to neutralization by the CH103 lineage and, therefore, were able to optimally drive the CH103 lineage.

Example 3

The HIV-1 arms race in patient CH0505, in which CD4 binding site BnAbs develop over time (clonal lineage under "antibody") in response to HIV-1 virus evolution (virus evolution tree under "HIV-1"), is shown in FIG. 20. In the clonal lineage shown, env binding to the heterologous 63521 clade B transmitted founder Env increased 4 logs over the time of clonal lineage development.

Figure 21:
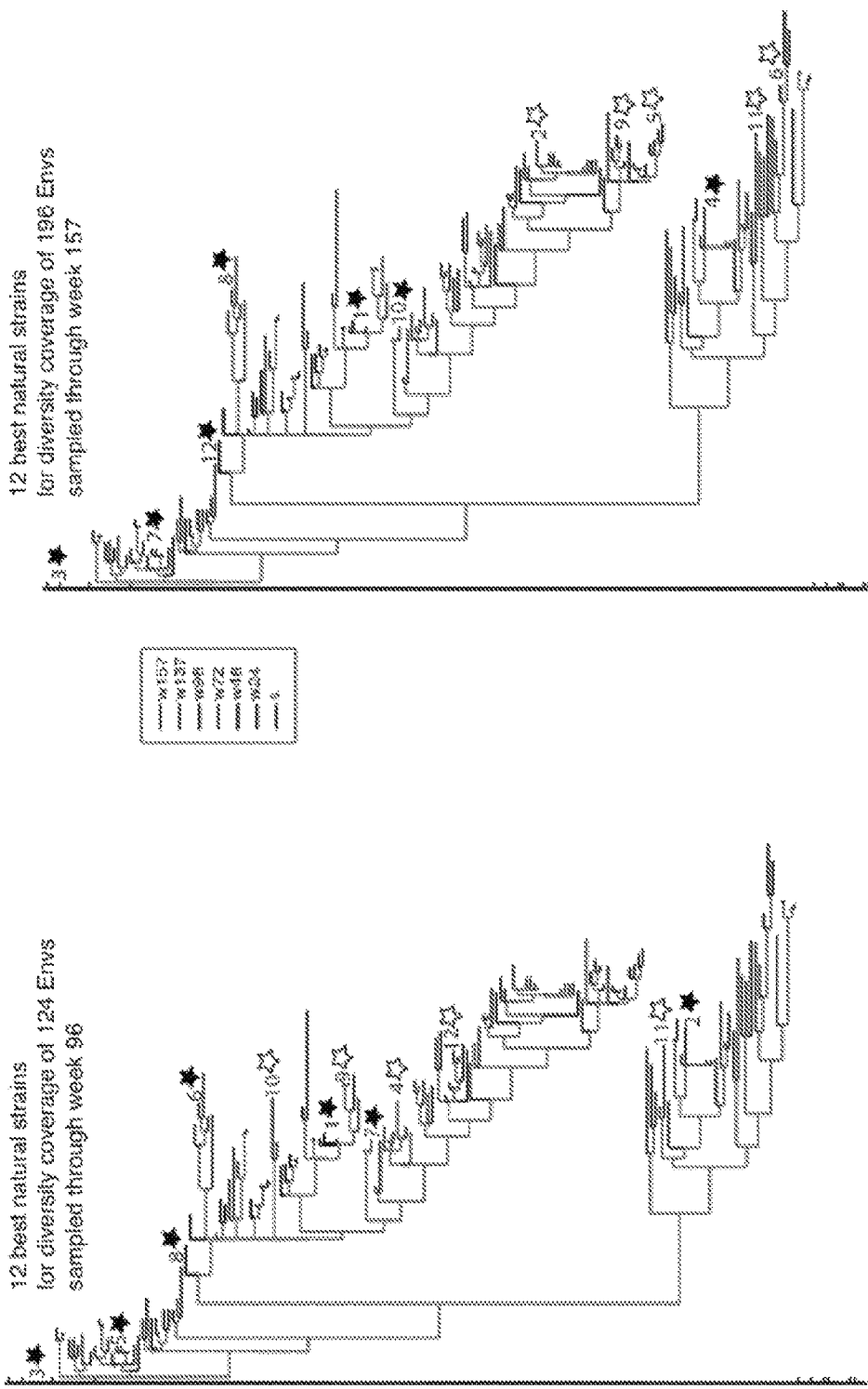
FIG. 21. The same virus clonal lineage tree of CH0505 shown in FIG. 20—starred in the right panel are examples of sequential envs chosen for immunogens and starred on the tree on the left are env sequences in FIG. 17.

FIG. 21 shows the same virus clonal lineage tree of CH0505 and shows at the stars on the right panel examples of sequential envs chosen for immunogens. The stars on the tree in the left panel are env sequences shown in FIG. 17

Figure 22:
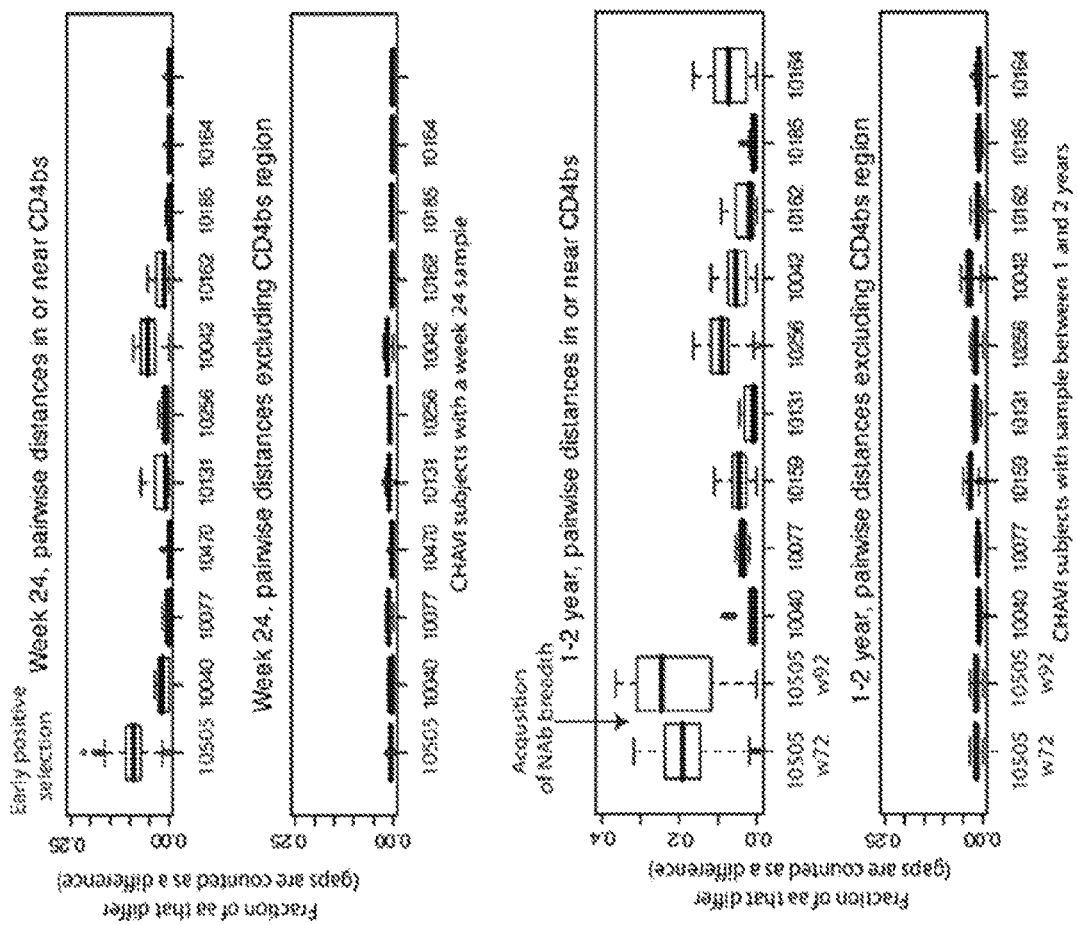
FIG. 22. Contact region for CD4, VRC01 and b12 and the signature sites that impact VRC01 and b12 neutralization are under intense selective pressure in CH0505.

The contact regions for CD4, VRC01, and b12, and the signature sites that impact VRC01 and b12 neutralization, are under intense selective pressure in CH0505. FIG. 22 illustrates several points: i) the 110 positions that are in or near the CD4bs are under far more intense selective pressure than the 846 positions that are not in the CD4bs region (see: "in or near CD4b" vs "excluding CD4bs"), ii) using the 10 CHAV117 samples that had a 24 week time point (blue), it can be seen that the diversification in or near the CD4bs is strikingly high in CH0505 very early on, already at 24 weeks, iii) using the 9 CHAV117 samples that had a sample between 1-2 years (range: 60-96 weeks), it can be seen that the pressure on the CD4bs region is unrelenting, and remarkable compared to other subjects, and iv) population breadth is first apparent at week 92, this autologous pressure first drove extensive diversification in the CD4 region, and then breadth developed in the presence of these diverse forms.

Figure 23:
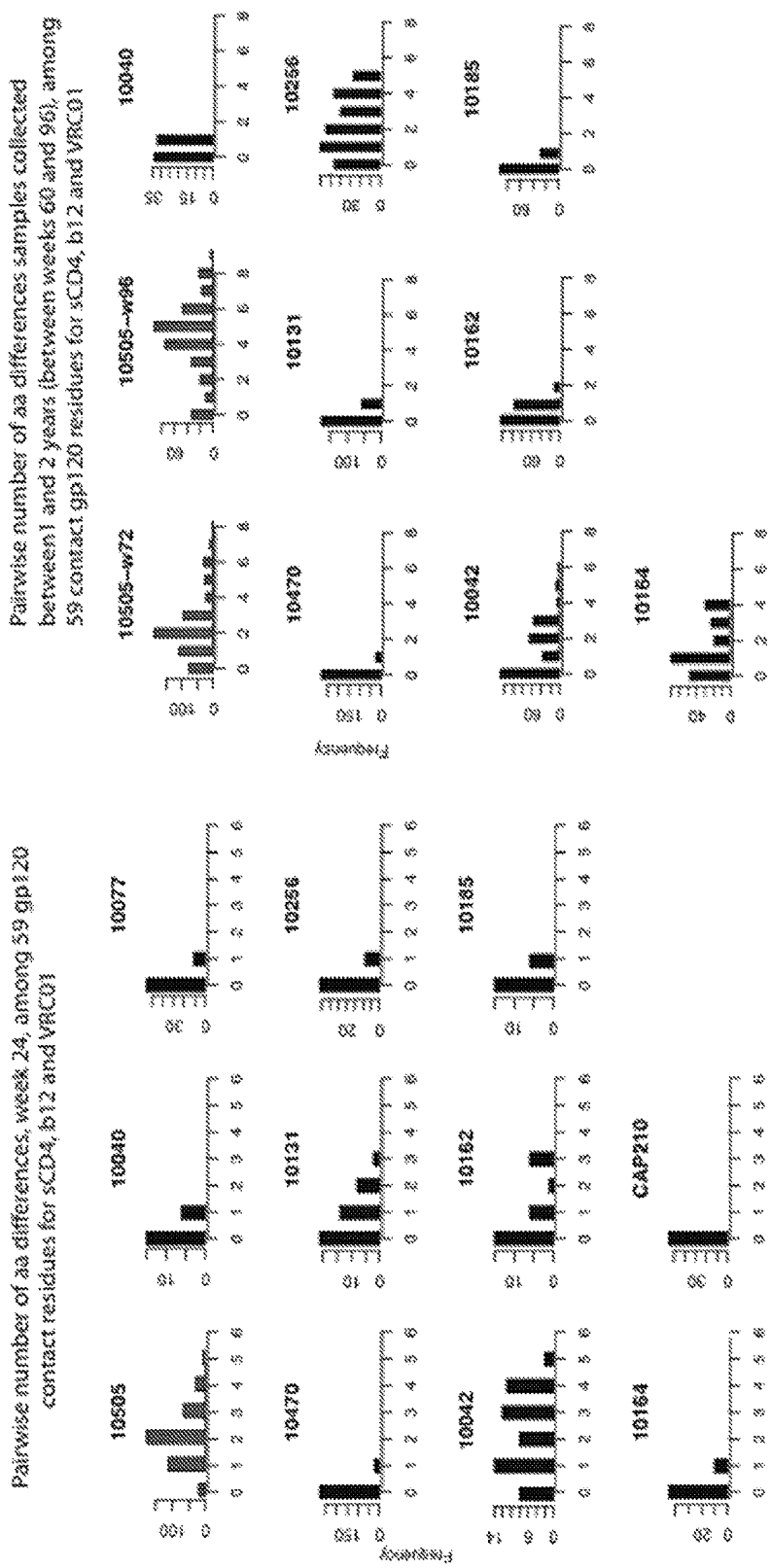
FIG. 23. The number of pairwise differences in just the CD4/b12/VRC01 contact residues is also relatively high for CH0505.

FIG. 23, like FIG. 22, shows how sites within the CD4 binding site of the CH0505 virus sequences are highly mutated in response to the antibodies generated in this patient.

Figure 24:
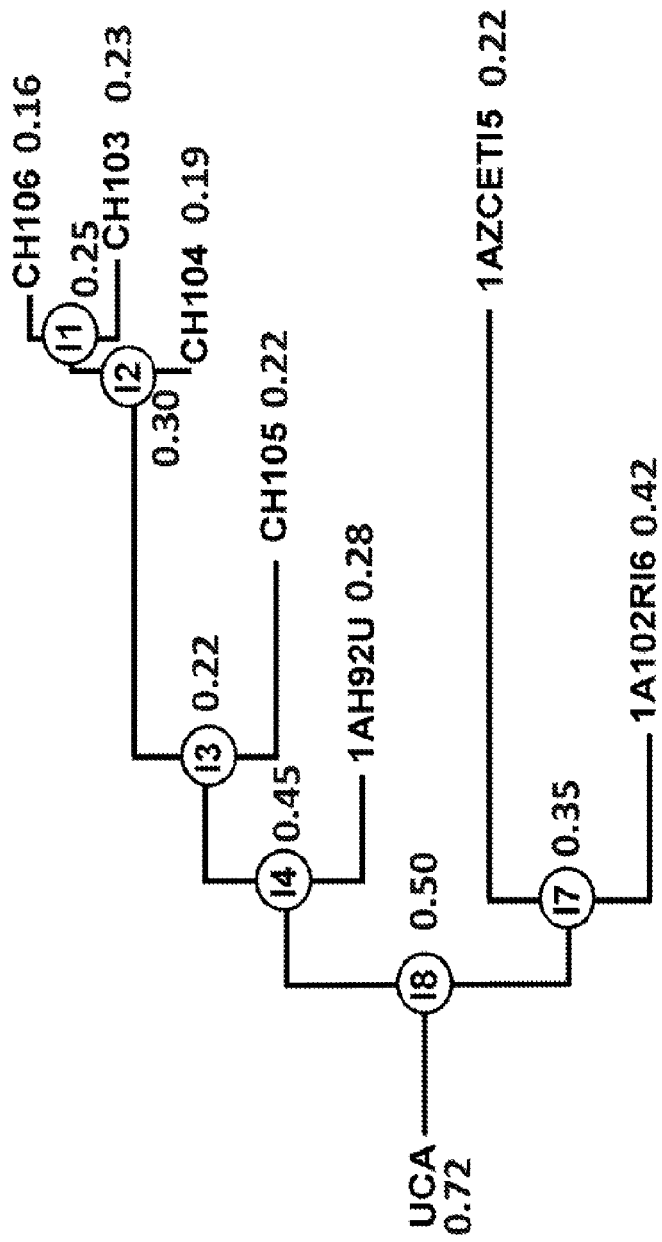
FIG. 24. Clonal lineage tree of Clone 103 from CH0505—binding to CH0505 transmitted/founder Env gp140 (EC50 µg/ml).

FIG. 24 shows that the single transmitted/founder virus Envelope gp140C of CH0505 binds remarkably well to the unmutated common ancestor of the CH103, 104 and 105 CD4 binding site bnAbs isolated from CH0505, and this env should be able to drive this clonal lineage.

Figure 25:
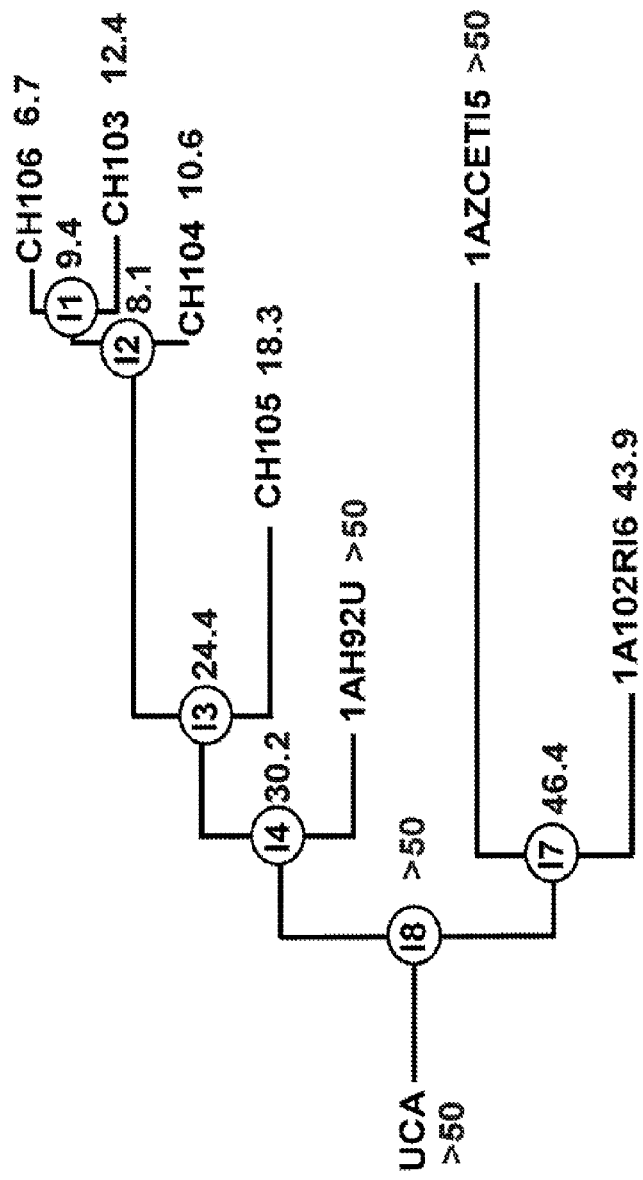
FIG. 25. Clonal lineage tree of Clone CH103 from CH0505-neutralization of tier 2 CH0505 (EC50, µ/ml).

FIG. 25 shows that neutralization arises early on in the clonal lineage at I4 antibody and there are relatively few mutations from the UCA to I4 that an immunogen must induce.

Figure 27:
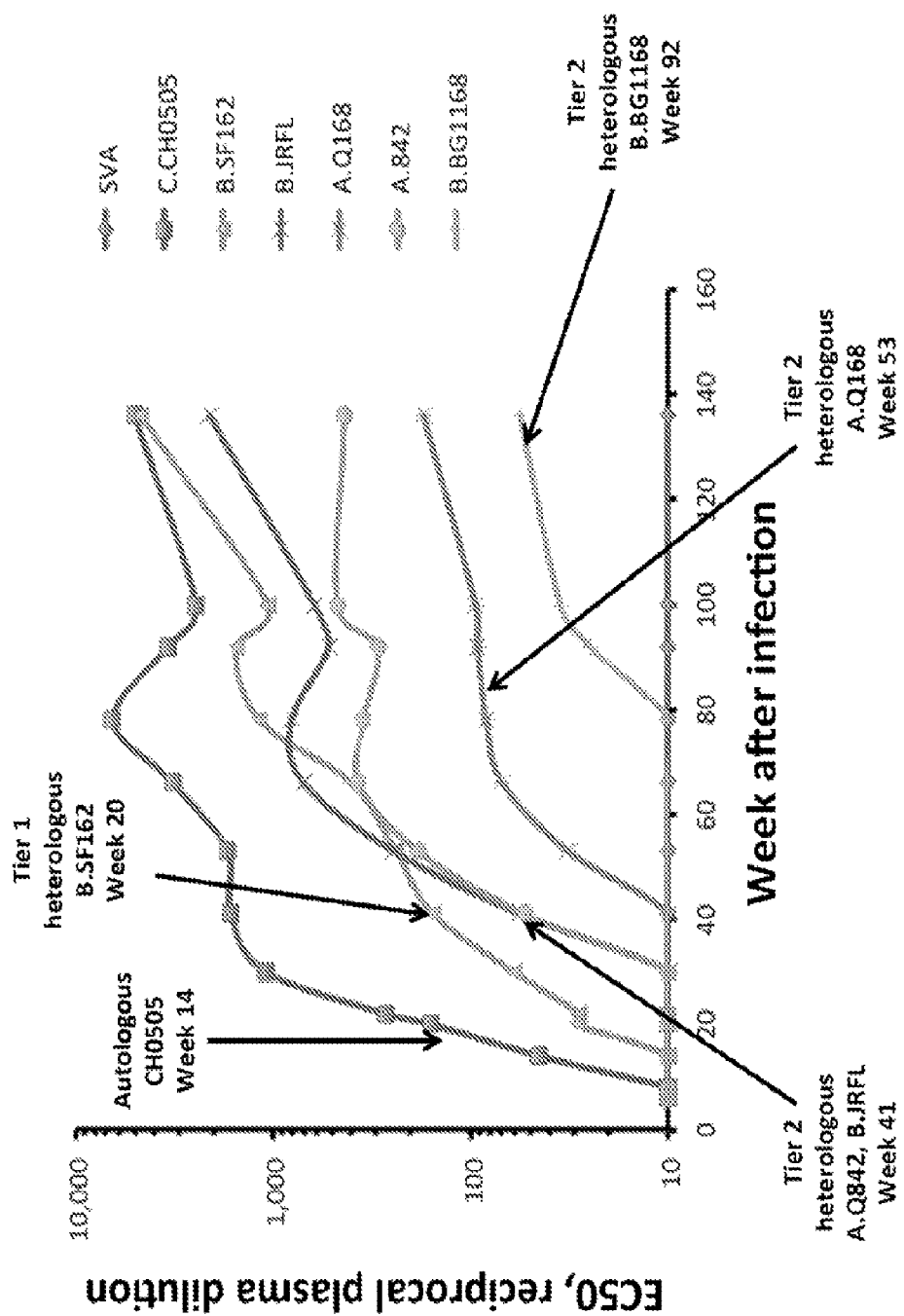
FIG. 27. Viral evolution during BnAb development in the HIV-1 infected individual (CH505).
Figure 27:
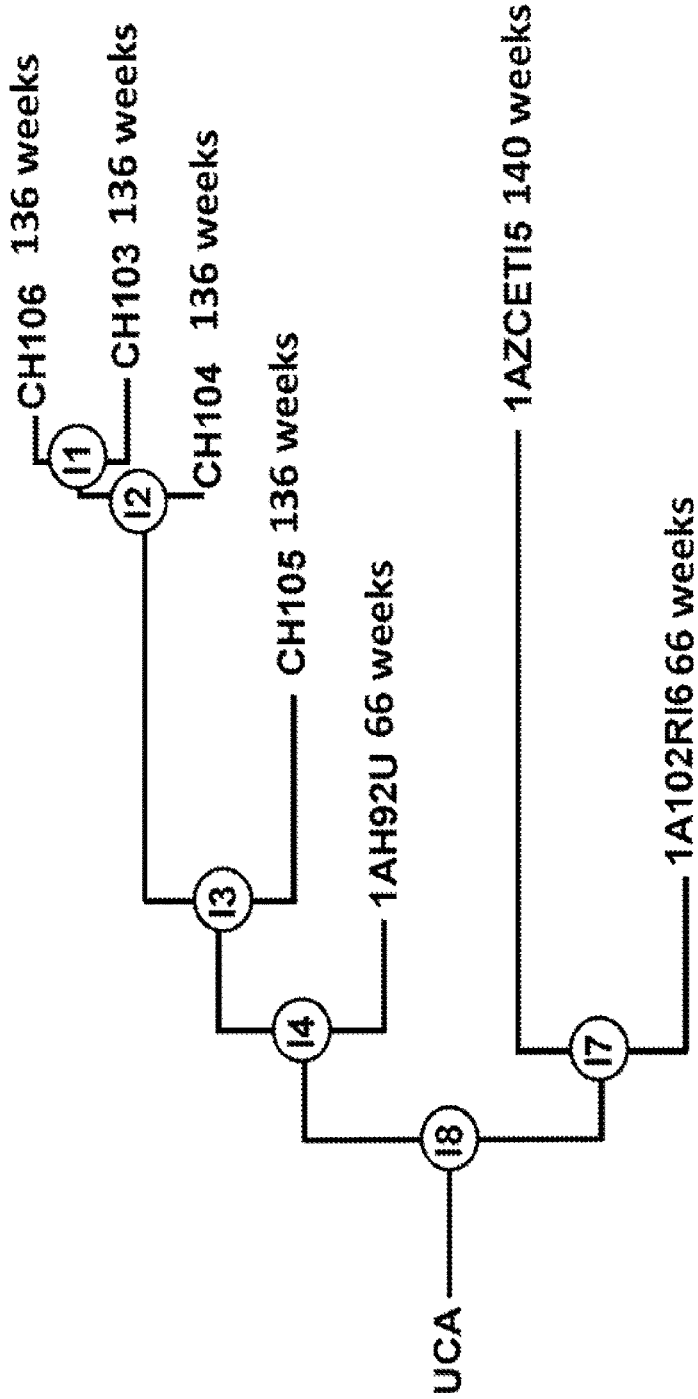
Figure 27:
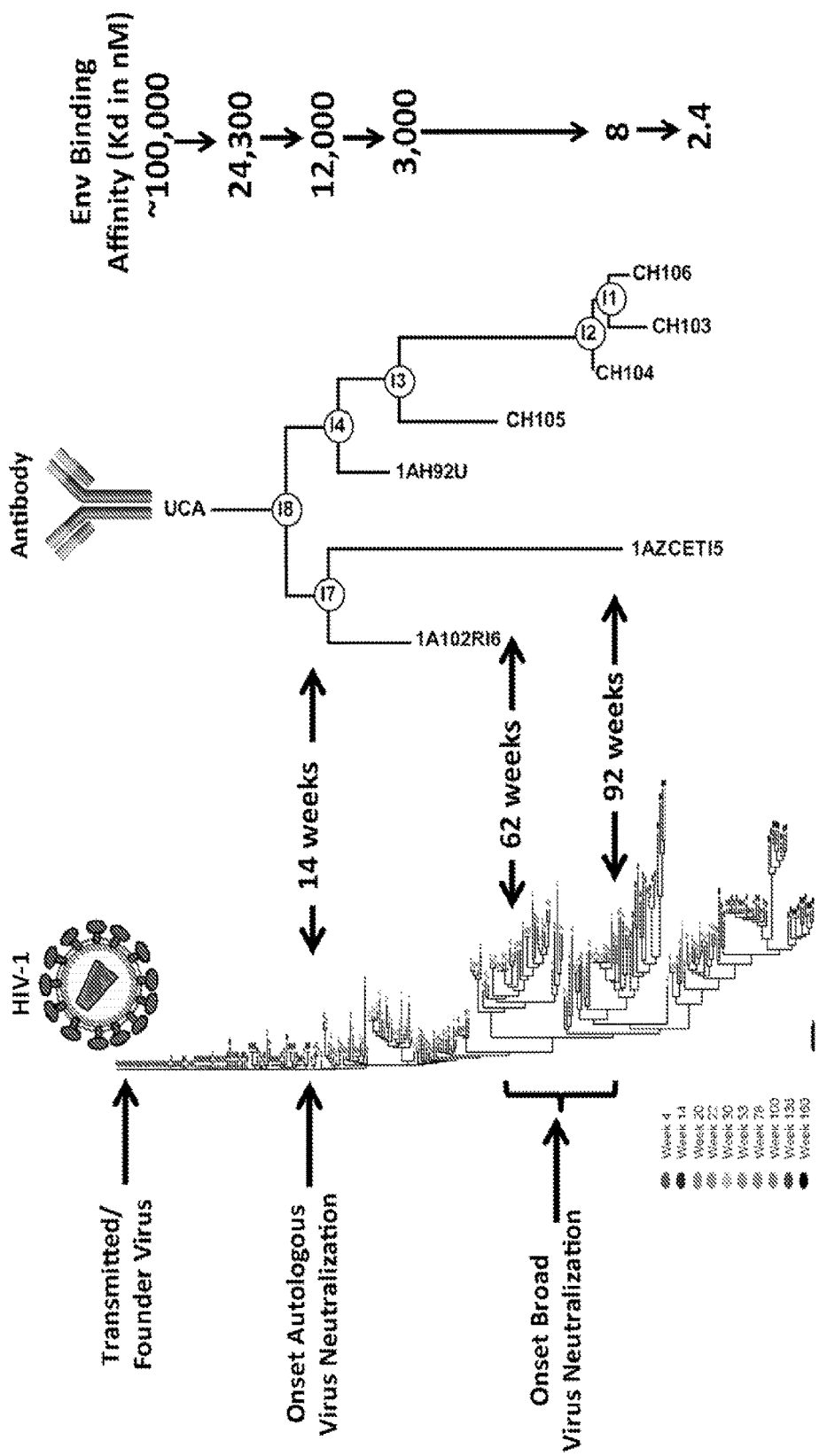
Figure 27:
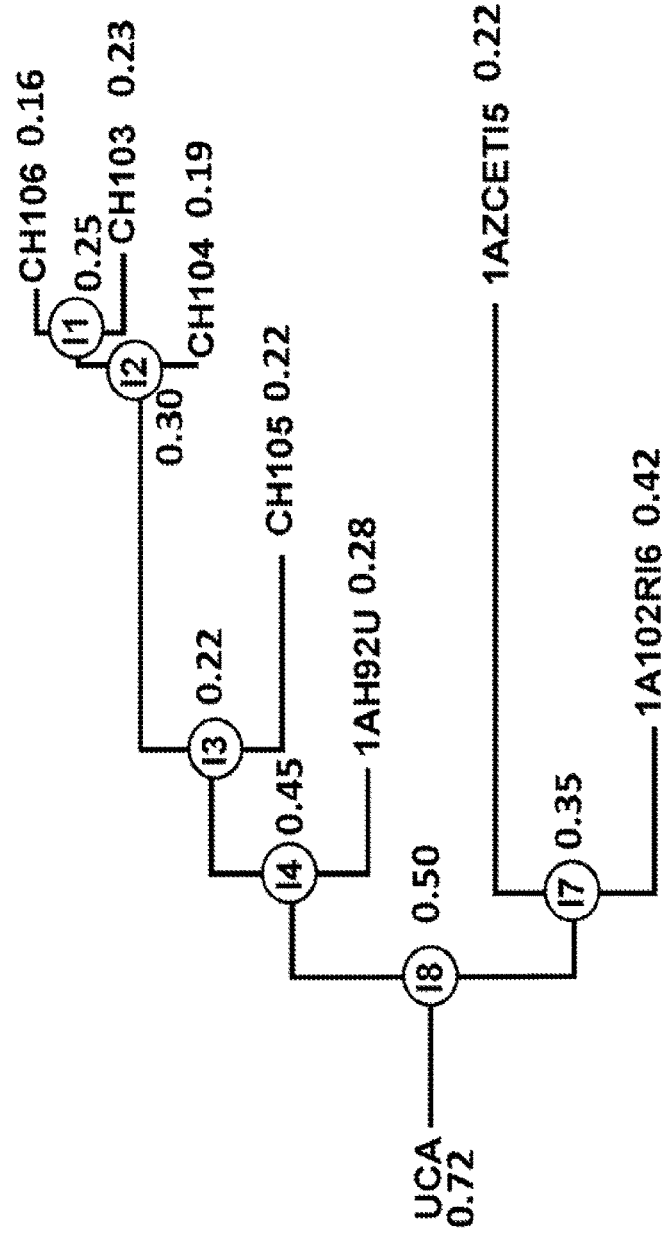
Figure 27:
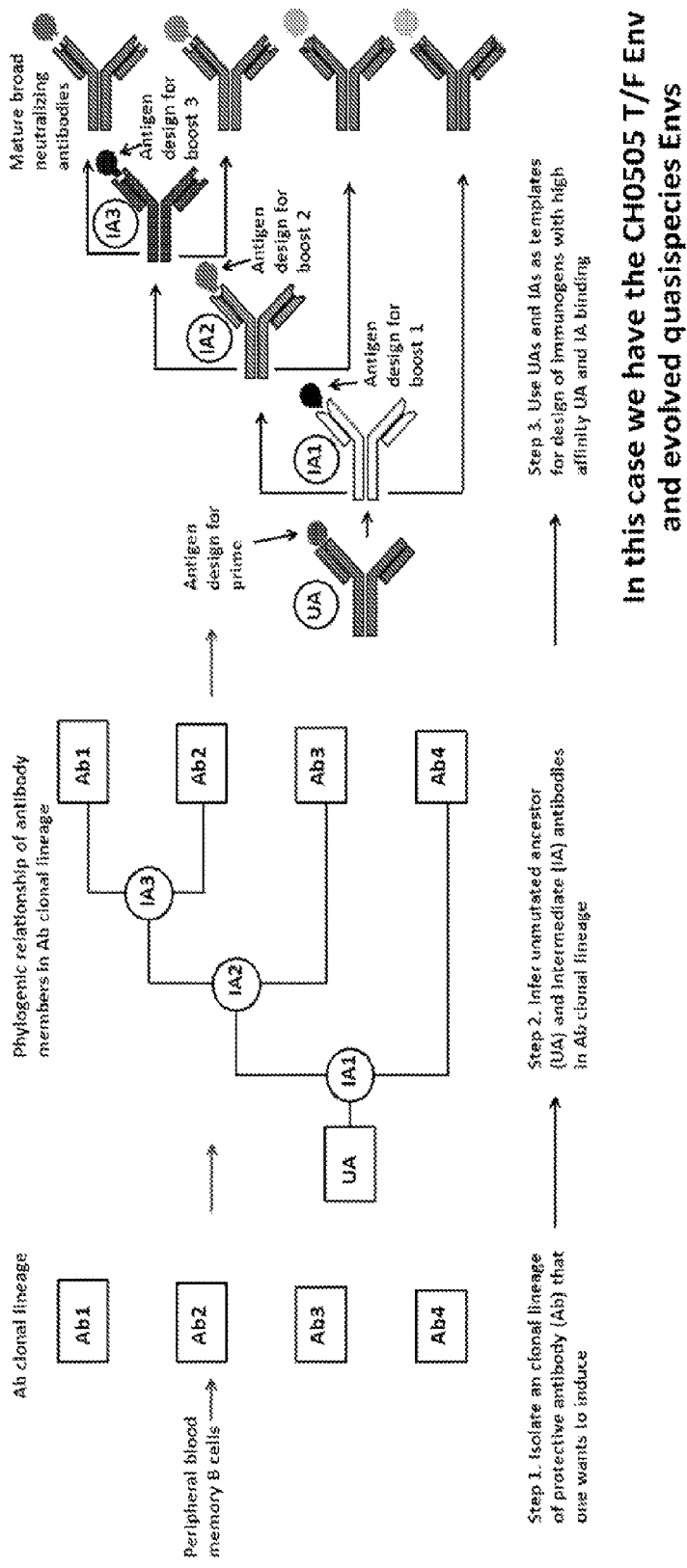
Figure 27:
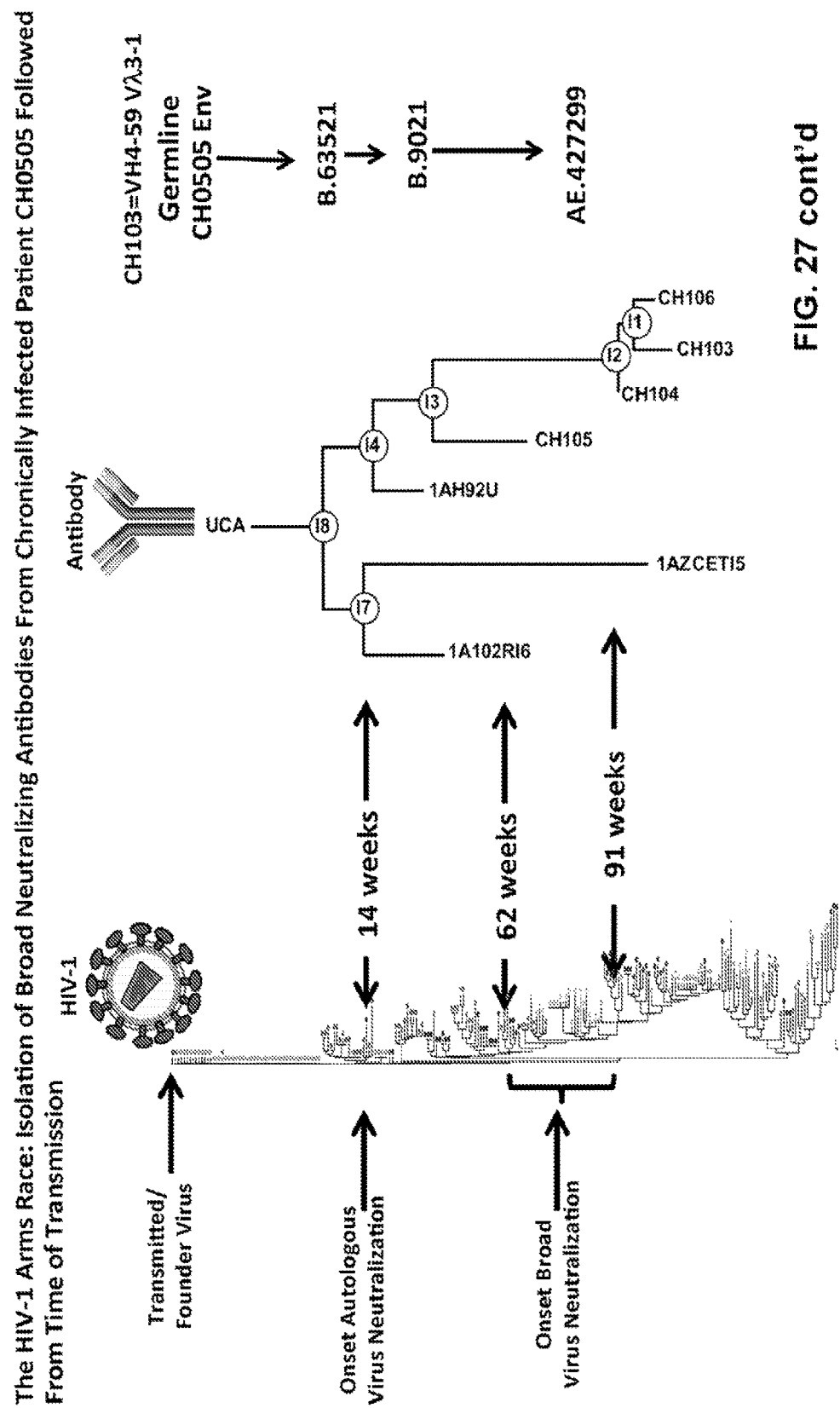

FIG. 27 shows viral evolution during BnAb development in the HIV-1 infected individual CH505.

Example 4

FIG. 26 shows an Env designed to focus induction of CD4 binding site antibodies by deletion of V1, V2 and V3 loop sequences that were highlighted in red font (underlined) (as example by CH0505_CON gp120) resulting in a core Env as example shown in example as CH0505_DV123core. This strategy can also be applied to the other HIV-1 Envs in the list of evolved CH0505 Envs (evolved CH0505 Envs are Env sequences obtained in sequential times after transmission) and well as the other heterologous HIV-1 Envs.

Example 5

BALB/c mice were immunized IM with 25 µg per dose of either the CH505 Transmitted/founder (T/F) Env delta 7 gp120 X4, the week 53.e16 CH505 variant X4, the week 78.33 CH505 variant X4, or the week 100B6 CH505 variant. In addition, BALB/c mice were also immunized IM with sequential Envs T/F, then week 53.e16 Env gp120, then week 78.33 Env gp120, then week 100B6 CH505 gp120 Env. A significant level of CD4 binding site antibodies occurs when a plasma titer of >1:200 to the resurfaced core 3 (RSC3) is present that is >2.8 times over plasma binding to the RSC3 with an isoleucine deletion at position 371 (Lynch R M et al. J. Virol. 86: 7588-95, 2012). Each group represents the mean of 3-4 mice per group. Data represent the ration of binding RSC# to RSCEDelta 371 proteins expressed as log Area Under the Curve (AUC) RSC3/log AUC RSC3Delta 371. Each animal end point binding titers were >200. FIG. 30 demonstrates that immunization with each individual gp120 alone X4 did not induce antibodies with a ration above 2 except for the week 533nv where the ratio went to ~3. However, the sequential immunization induced RSC3/RSC3D371 ratio of RSC3-binding antibodies of >4 demonstrating the superiority of this particular combination of antibodies of inducing the desired type of CD4 binding site antibodies over individual Env immunizations.

All documents and other information sources cited herein are hereby incorporated in their entirety by reference. Also incorporated by reference are Wei et al, Nature 422: 307-12 (2003); McMichael et al, Nature Rev. Immunol. 10:11-23 (2010) Epub 2009 Dec. 11; Cohen et al, New Eng. J. Med. 364:1943-54 (2011), Bar et al, PLoS Pathog. 8: e1002721, Epub 2012 May 31; Goonetilleke et al, J. Exp. Med. 206:1253-72 (2009); Keele et al, Proc. Natl. Acad. Sci. 105:7552-7 (2008), Gray et al, J. Virol. 85:4828-40 (2011); Moore et al, PLoS Pathogens 5:e1000598, Epub 2009, September 18; Gray et al, J. Virol. 83:11265-74 (2009); Morris et al, PLoS One 6:e23532 (2011) September 30; McElrath and Haynes, Immunity 33: 542-54 (2010) and Haynes et al, Nature Biotech. 30:423-33 (2012)).

SEQUENCE LISTING (926 sequences)

SEQ ID NO: 1 - DNA, 363 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccaattctccctgaagctgagctctgtgaccgctgcggacacggccgtgtattactgtgcgagcctgcccagggggcagttagtcaatgcctactttgactactggggccagggaaccctggtcaccgtctcctca

SEQ ID NO: 2 - DNA, 363 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagcctgcccaggggggagttagtcaatgcctactttgactactggggccagggaaccctggtcaccgtctcctca

SEQ ID NO: 3 - DNA, 363 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccaattctccctgaagctgagctctgtgaccgctgcggacacggccgtgtattactgtgcgagcctgcccaggggggagttagtcaatgcctactttgactactggggccagggaaccctggtcaccgtctcctca

SEQ ID NO: 4 - DNA, 363 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagcctgcccagggggcaattaatcaatgcctactttgactactggggccagggaaccctggtcaccgtctcctca

SEQ ID NO: 5 - DNA, 363 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagcctgcccaggggggagttagtcaacgcctactttgactactggggccagggaaccctggtcaccgtctcctca

SEQ ID NO: 6 - DNA, 363 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagcctgcccaggggggagttagtccgtgcctactttgactactggggccagggaaccctggtcaccgtctcctca

SEQ ID NO: 7 - protein, 121 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCASLPRGQLVNAYFDYWGQGTLVTVSS

SEQ ID NO: 8 - protein, 121 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCASLPRGELVNAYFDYWGQGTLVTVSS

SEQ ID NO: 9 - protein, 121 aa, Artificial Sequence; identical to SEQ ID NO: 8
  Description of Artificial Sequence: Synthetic polypeptide

SEQ ID NO: 10 - protein, 121 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCASLPRGQLINAYFDYWGQGTLVTVSS

SEQ ID NO: 11 - protein, 121 aa, Artificial Sequence; identical to SEQ ID NO: 8
  Description of Artificial Sequence: Synthetic polypeptide

SEQ ID NO: 12 - protein, 121 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCASLPRGELVRAYFDYWGQGTLVTVSS

SEQ ID NO: 13 - protein, 121 aa, Artificial Sequence
  Description of Artificial Sequence: Synthetic polypeptide
QVQLQESGPGLVKPSETLSLTCTVSGGSIVSYYWSWIRQPPGKGLEWIGYMYYSGSTNYNPSLKSRVTISIDTSKNQFSLKLRSVTAADTAVYYCASLPRGQLILGYFDYWGQGTLVTVSS

SEQ ID NO: 14 - protein, 121 aa, Artificial Sequence
  Description of Artificial Sequence: Synthetic polypeptide
QVQLQESGSGLVKPSETLSLTCTVSGGSISSYYWSWIRQPPGKGLEWIGFIYYSGSTNYNPSLKSRVTISIDTSKNQFSLKLRSVTAADTAVYYCASLPRGQLILGYFDYWGQGTLVTVSS

SEQ ID NO: 15 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 16 - protein, 847 aa, Human immunodeficiency virus
MKVRGIKRNLPQWWKWGTMLLGMLMTYSVAEQLWVTVYYGVPVWKDAETTLFCASDAKAYSTEKHNIWATHACVPTDPNPQEIHLENVTEEFNMWKNNMVEQMHTDIISLWDQSLRPCVKLTPLCVTLNCTNVNNNTTNVNNNTGWDEERKNCSFNITTELRDKRQKVYSLFYKLDVVQIDNSSYRLINCNTSAITQACPKVTFEPIPIHYCAPAGFAILKCKDEKFNGTGPCKNVSTVQCTHGIKPVVSTQLLLNGSLAEKEVMIRSENFTNNAKNILVQFKEPVKINCTRPDNNTRTSIRIGPGQAFYATGIIGDIRQAYCTVNGSEWNKALQKVVEQLRSSFENKTIIFANSSGGDLEITTHSFNCGGEFFYCNTSGLFDSTWNDTSTDMANSDSRQENGTITLPCRIKQIINMWQRTGQAIYAPPIQGAIRCVSNITGLILTRDGGNNNSTNETFRPGGGDMRDNWRSELYKYKVVKIEPLGVAPTKARRRVVGREKRAVGIGAVFLGFLGAAGSTMGAASITLTVQARQLLSGIVQQQSNLLKAIEAQQHLLRLTVWGIKQLQARVLAVERYLKDQQLLGIWGCSGKLICTTNVPWNSSWSNKSQSEIWENMTWLQWEKEISNYTQIIYTLIEESQNQQEKNEQDLLALDKWASLWNWFDISKWLWYIRIFIMIVGGLIGLRIVFAVLSVVNRVRQGYSPLSFQTLLPAPRGPDRPDGIEEEGGEQGRGRSRQLVNGFSTLIWDDLRNLCLFSYHRLRDLILIAARIVELLGRRGWEAIKYLWNLLQYWIQELKNSAISLLNTTAIAVAEGTDRAIEIIQRAITAVLNIPTRIRQGFERALL

SEQ ID NO: 17 - protein, 856 aa, Human immunodeficiency virus
MRAMGIQMNCQNLWRWGTMILGMIIFCSAVDNLWVTVYYGVPVWKEAETTLFCASDAKAYETEKHNVWATHACVPTDPNPQEIHLENVTEEFNMWKNNMVEQMHTDIISLWDQSLKPCVKLTPLCVTLDCNNVTNNGTSDMREEIKNCSFNMTTELRDKRQKVYSLFYKLDIVQINEDQGNSSNNKYRLITCNTSAITQACPKVTFEPIPIHYCAPAGFAILKCKDEEFNGIGPCKNVSTVQCTHGIKPVVSTQLLLNGSLAEKEVKIRCENITNNAKTIIVQLVNPVKINCTRPNNNTRKSIHIGPGQAFYATGDIIGDIRQAHCNVNRTEWNNTLHQVVEQLRKHFNKTINFANSTGGDLEITTHSFNCGGEFFYCNTTNLFNSTWNHTATDMASMNSTESNDTIILPCRIKQIINMWQRVGQAMYAPPIRGVIRCESNITGLILTRDGGNTNSTRETFRPGGGDMRDNWRSELYKYKVVKIEPLGVAPTKAKRRVVEREKRAVGIGAVFIGFLGAAGSTMGAASITLTVQARQLLSGIVQQQSNLLRAIEAQQHLLKLTVWGIKQLQARVLAVERYLKDQQLLGIWGCSGKLICTTSVPWNSSWSNKSQNEIWDNMTWLQWDKEISNYTQIIYDLLEESQNQQEKNEQDLLALDKWANLWNWFDISNWLWYIKIFIMIVGGLIGLRIVFAVLSVINRVRQGYSPLSFQTHTPNPRGLDRPERIEEEGGEQDKNRSIRLVSGFLALAWDDLRSLCLFSYHRLRDFILIVARTVELLGHSSLKGLRLGWEGLKYLGNLLSYWGRELRISATNLLDTIAIVIAGWTDRVIEIGQRLCRAFLNIPRRIRQGFERALL

SEQ ID NO: 18 - protein, 869 aa, Human immunodeficiency virus
MRVKGIMKNCQHLWRWGIMLLGILMICSATEKLWVTVYYGVPVWKEATTTLFCASDAKAYETEVHNVWATHACVPTDPNPQEVKLENVTEDFNVWKNDMVTQMHEDIISLWDQSLKPCVKLTPLCVTLHCTDVNTTCITTNNSTMTNSSNSSTEGNCSSYNYNGREELRNCSFNITTSIQDKVQDYAIFYKLDIVPIKSDNSDNTSYRLINCNTSVITQACPKISFEPIPIHYCAPAGFAILKCNDKKFSGKGTCNNVSTVQCTHGIRPVVSLTVVNGSLAEEGVVLRSENFTNNAKTIIVQLKDPVKIECERPNNNTIKSIHLGPGRAWHATGQIIGDIRKAFCTLNSTNWTNTLKQMVEKLREQFENKTIAFNQSTGGDPEIVMHTFNCGGEFFYCNTTQLFNSIWYNTTTNSSWNNKTWSNNTITLPCRIKQIINMWQQVGKAIYAPPIKGKIKCISNITGLLLTRDGGDTNNGTEIFRPGGGDMRDNWRSELYKYKVVQIEPLGVAPTKAKRRVVQREKRAVGLGAMFLGFLGAAGSTMGAASITLTVQARQLLSGIVQQQNNLLRAIEAQQHLLQLTVWGIKQLQARVLAVERYLKDQQLLGIWGCSGKLICTTAVPWNASWSNKSQEEIWDNLTWMQWEKEINNYTSVIYTLLEQSQNQQEKNEQELLELDKWASLWNWFDITKWLWYIRIFIMIVGGLIGLRIVFAVISIVNRVRQGYSPLSLQTRFPAPRGPDRPEGIEEEGGGRDRNISTRLVSGFLPLIWDDLRSLCLFSYHRLRDFLLIVARIVELLGRRGWEALKYWWNLLQYWSQELKNSAVSLLNTTAIVVAEGTDRIIEALQRICRAILHIPTRIRQGFERALL

SEQ ID NO: 19 - protein, 850 aa, Human immunodeficiency virus
MRVKGIRKNYQHLWRGGTLLLGIIVICSAVEKLWVTVYYGVPVWKEATTTLFCASDAKAYDTEVHNVWATHACVPTDPNPQEVVLGNVTEKFNMWKNNMVEQMQEDIISLWDQSLKPCVKLTPLCVTLNCKDVNATNTTNGSEGTMERGEIKNCSFNITTSIRDEVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTTDMEGSNNTEGNTITLPCRIKQIINMWQEVGKAMYAPPIRGQIRCSSNITGLLLTRDGGINENGTEIFRPGGGDMKDNWRSELYKYKVVKIEPLGVAPTKAKRRVVQREKRAVGIGAVFLGFLGAAGSTMGAASMTLTVQARLLLSGIVQQQNNLLRAIEAQQRMLQLTVWGIKQLQARVLAVERYLGDQQLLGIWGCSGKLICTTAVPWNASWSNKSLDRIWNNMTWMEWEREIDNYTSEIYTLIEESQNQQEKNEQELLELDKWASLWNWFDITKWLWYIKIFIMIVGGLIGLRIVFTVLSIVNRVRQGYSPLSFQTLLPAPRGPDRPEGIEEEGGERDRDRSGRLVNGFLALIWVDLRSLCLFSYHRLRDLLLTVTRIVELLGRRGWEVLKYWWNLLQYWSQELKNSAVSLLNATAIAVAEGTDRIIEALQRTYRAILHIPTRIRQGLERALL

SEQ ID NO: 20 - protein, 853 aa, Human immunodeficiency virus
MRVKGIRKNYQHLWRGGTLLLGMLMICSAVEKLWVTVYYGVPVWKEATTTLFCASDAKAYDTEVHNVWATHACVPTDPNPQEIVLENVTENFNMWKNNMVEQMHEDIISLWDQSLKPCVKLTPLCVTLHCTNLKNATNTKSSNWKEMDRGEIKNCSFKVTTSIRNKMQKEYALFYKLDVVPIDNDNTSYKLINCNTSVITQACPKVSFEPIPIHYCAPAGFAILKCNDKKFNGSGPCTNVSTVQCTHGIRPVVSTQLLLNGSLAEEGVVIRSENFTDNAKTIIVQLKESVEINCTRPNNNTRKSITIGPGRAFYATGDIIGDIRQAHCNISGEKWNNTLKQIVTKLQAQFGNKTIVFKQSSGGDPEIVMHSFNCGGEFFYCNSTQLFNSTWNNTSTDMANIGPNNTNGTITLPCRIKQIINRWQEVGKAMYAPPIRGQIRCSSNITGLLLTRDGGKEISNTTEIFRPGGGDMRDNWRSELYKYKVVKIEPLGVAPTKAKRRVVQREKRAVTLGAMFLGFLGAAGSTMGAASLTLTVQARQLLSGIVQQQNNLLRAIEAQQHLLQLTVWGIKQLQARVLAVERYLKDQQLLGIWGCSGKLICTTAVPWNASWSNKSLDQIWNNMTWMEWEREIDNYTNLIYTLIEESQNQQEKNEQELLELDKWASLWNWFDISKWLWYIKIFIMIVGGLVGLRIVFTVLSIVNRVRQGYSPLSFQTRFPAPRGPDRPEGIEEEGGERDRDRSSPLVHGLLALIWDDLRSLCLFSYHRLRDLILIAARIVELLGRRGWEALKYWGNLLQYWIQELKNSAVSLFDAIAIAVAEGTDRIIEVAQRIGICFLHIPRRIRQGFERALL

SEQ ID NO: 21 - protein, 862 aa, Human immunodeficiency virus
MKVREILRNWRQWWIWGILGFWMLMICNVVVGNLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTSAMTQACPKVSFDPIPIHYCAPAGYAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATDMANTSRNATNATITLPCRIRQIINMWQEVGRAMYAPPIAGNITCVSNITGLLLVRDGGNGDTNDTETFRPGGGDMKNNWRSELYKYKVVEIKPLGVAPTEAKRRVVEREKRAVGIGAVLLGFLGAAGSTMGAASITLTAQARQVLSGIVQQQSNLLRAIEAQQHLLQLTVWGIKQLQTRVLALERYLKDQQLLGLWGCSGRLICTTAVPWNSSWSNKSLTDIWDNMTWMQWDKEVSNYTNTIYRLLEDSQSQQEKNEKDLLALDSWKNLWTWFDISNWLWYIKIFIMVVGGLIGLRIIFAVISIVNRVRQGYSPLSLQTLTQSPGGPDRLGRIEEEGGEQDRDRSIRLVNGFLTLAWDDLRSLCLFSYHRLRDFILIAARVVELLGHSSLRGLQKGWEALKYLGSLVQYWCLELKRSAISLLDSIAMAVAEGTDRIIELVQRICRGIYHIPRRIRQGFEAALL

SEQ ID NO: 22 - protein, 856 aa, Human immunodeficiency virus
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYKLTSCNTSVITQACPKVSFEPIPIHYCAPAGFAILKCNNKTFNGTGPCTNVSTVQCTHGIRPVVSTQLLLNGSLAEEEVVIRSVNFTDNAKTIIVQLNTSVEINCTRPNNNTRKRIRIQRGPGRAFVTIGKIGNMRQAHCNISRAKWNNTLKQIASKLREQFGNNKTIIFKQSSGGDPEIVTHSFNCGGEFFYCNSTQLFNSTWFNSTWSTEGSNNTEGSDTITLPCRIKQIINMWQKVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERYLKDQQLLGIWGCSGKLICTTAVPWNASWSNKSLEQIWNHTTWMEWDREINNYTSLIHSLIEESQNQQEKNEQELLELDKWASLWNWFNITNWLWYIKLFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 23 - protein, 210 aa, Human immunodeficiency virus
KPVVSTQLLLNGSLAKEEIVIRSENLTDNAKTIIVHLKESVEIVCTRPGNGGSGSGGDTRQAHCNISEEKWNKTLQKVSKILQEHFPNKAIKFEPHSGGDLEITTHSFNCRGEFFYCNTTKLFNGTYNSTANSTGSVSNTTITLPCRIKQIVNMWQGVGRAMYAPPIKGNITCKSIITGLLLTRDGGNDDNDTETFRPGGGDMRDNWRSE

SEQ ID NO: 24 - protein, 231 aa, Human immunodeficiency virus
KPVVSTQLLLNGSLAEDEIIIRSENLTDNSKNIIVHLNESVVINCTRPSNNTVKSIRIGPGQTFYRTGDIIGDIRQAYCNVNGTKWYEVLRNVTKKLKEHFNNKTIVFQQPPPGGDLEITTHHFNCRGEFFYCNTTELFNNTCVNETINNGTEGWCKGDIILPCRIKQIINLWQEVGQAMYAPPVSGQIRCISNITGIILTRDGGNGKNGTLNNETFRPGGGNMKDNWRSE

SEQ ID NO: 25 - protein, 223 aa, Human immunodeficiency virus
KPVVSTQLLLNGSLAEEEVVIRSKNFTDNAKIIIVQLNETVEINCTRPGNNTRKSIHIAPGRTFYATGEIIGDIRRAHCNISREKWNTTLHRIATKLREQYNKTIVFNQSSGGDPEIVMHSVNCGGEFFYCNTSKLFNSTWNSTGGSISEDSENITLPCRIKQIVNMWQEVGKAMYAPPIRGQIRCSSNITGLLLTRDGGINQSISETFRPGGGDMRDNWRSE

SEQ ID NO: 26 - protein, 238 aa, Human immunodeficiency virus
RPVVSTQLLLNGSLAEKEVIIRSDNFSDNAKNIIVQLKEYVKINCTRPNNNTRKSIHIGPGRAFYATGEIIGNIRQAHCNISRSKWNDTLKQIAAKLGEQFRNKTIVFNPSSGGDLEIVTHSFNCGGEFFYCNTTKLFNSTWIREGNNGTWNGTIGLNDTAGNDTIILPCKIKQIINMWQEVGKAMYAPPIRGQIRCSSNITGLILTRDGGKDDSNGSEILEIFRPGGGDMRDNWRSE

SEQ ID NO: 27 - protein, 228 aa, Human immunodeficiency virus
KPVVSTQLLLNGSLAEEEIIIRSENLTNNAKTIIVHLNESVNIVCTRPNNNTRKSIRIGPGQTFYATGDIIGNIRQAHCNINESKWNNTLQKVGEELAKHFPSKTIKFEPSSGGDLEITTHSFNCRGEFFYCNTSDLFNGTYRNGTYNHTGRSSNGTITLQCKIKQIINMWQEVGRAIYAPPIEGEITCNSNITGLLLLRDGGQSNETNDTETFRPGGGDMRDNWRSE

SEQ ID NO: 28 - protein, 227 aa, Human immunodeficiency virus
KPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSE

SEQ ID NO: 29 - protein, 121 aa, Artificial Sequence; identical to SEQ ID NO: 7
  Description of Artificial Sequence: Synthetic polypeptide

SEQ ID NO: 30 - protein, 121 aa, Artificial Sequence
  Description of Artificial Sequence: Synthetic polypeptide
QVQLQESGPGLVKPSETLSLTCTVSGGSMSSYYWSWIRQSPGKGLEWIGYIYYTGDTNYNPSLKSRVTISVDTSENQFSLKLRSVTAADTAVYYCASLPRGQLVNAYFDYWGQGTLVTVSS

SEQ ID NO: 31 - protein, 121 aa, Artificial Sequence
  Description of Artificial Sequence: Synthetic polypeptide
QVQLQESGPGLVKSSETLSLTCTVSGGSMGGYYWSWIRQSPVKGLEWIGYIYHTGDTNYNPSLESRVTVSVDTSENQFSLKLRSVTAADTAVYYCASLPRGQLVNAFFDYWGQGTLVTVSS

SEQ ID NO: 32 - protein, 121 aa, Artificial Sequence
  Description of Artificial Sequence: Synthetic polypeptide
QVQLQESGPGLVKSSETLSLTCTVSGGSMGGYYWSWLRQSPVKGLEWIGYIFHTGHTNYNPSLESRVTVSVDTSENQFSLRLRSVTAADTAVYYCASLPRGQLVNAFFDNWGQGTLVTVAS

SEQ ID NO: 33 - protein, 121 aa, Artificial Sequence
  Description of Artificial Sequence: Synthetic polypeptide
QVQLQESGPGVVKSSETLSLTCTVSGGSMGGTYWSWLRLSPGKGLEWIGYIFHTGHTNYNPSLEGRVSISVDTSEDQFSLRLRSVTAADTAVYFCASLPRGQLVNAYFRNWGRGTLVSVTA

SEQ ID NO: 34 - protein, 121 aa, Artificial Sequence
  Description of Artificial Sequence: Synthetic polypeptide
QVQLQESGPGVVKSSETLSLTCTVSGGSMGGTYWSWLRLSPGKGLEWIGYIFHTGHTNYSPSLKGRVSISVDTSEDQFSLRLRSVTAADTAVYFCASLPRGQLVNAYFRNWGRGTLVSVTA

SEQ ID NO: 35 - protein, 121 aa, Artificial Sequence
  Description of Artificial Sequence: Synthetic polypeptide
QVQLQESGPGLVKPSETLSLTCSVSGGSMTSYYWSWIRQTPGKGLEWIGYIYYTGDTNYNPSLKSRVTISVDAPENQFSLKLRSVTAADTAVYYCASLPRGQLVNAYFDYWGQGTLVTVSS

SEQ ID NO: 36 - protein, 121 aa, Artificial Sequence
  Description of Artificial Sequence: Synthetic polypeptide
QVQLQESGPGLVKPSETLSLTCSVSGGSMTESYWNWMRLTPTGGLEWIGYIFHSGSTNYNPALKSRVTISVDAPGNHFSLRLRSLTAADTATYFCARLRRGQLVNAYFGSWGPGILVTVSS

SEQ ID NO: 37 - protein, 121 aa, Artificial Sequence
  Description of Artificial Sequence: Synthetic polypeptide
QVQLQESGPGLVKSSETLSLTCTVSGGSMGGYYWSWIRQSPLKGLEWIGYIYHAGDTNYNPSLESRVTVSVDTSKNQFSLKLRSVTAADTAVYYCASLPRGQLVNAFFDHWGQGTLVTVSS

SEQ ID NO: 38 - protein, 121 aa, Artificial Sequence
  Description of Artificial Sequence: Synthetic polypeptide
QVQLQESGPGLVKPSETLSLTCSVSGGSMTSYYWFWIRQTPGKGLEWIGYIYYTGETHYNPSLKSRVTISVDAPANQFSLKLRSVTAADTGVYWCASLPRGQLIHAYFHYWGQGALVTVSS

SEQ ID NO: 39 - protein, 121 aa, Artificial Sequence
  Description of Artificial Sequence: Synthetic polypeptide
QVQLQESGPGVVKSSETLSLTCTVSGGSMGGTYWSWLRLSPGKGLEWIGYIFHTGETNYSPSLKGRVSISVDTSEDQFSLRLRSVTAADTAVYFCASLPRGQLVNAYFRNWGRGSLVSVTA

SEQ ID NO: 40 - protein, 121 aa, Artificial Sequence; identical to SEQ ID NO: 33
  Description of Artificial Sequence: Synthetic polypeptide

SEQ ID NO: 41 - protein, 121 aa, Artificial Sequence
  Description of Artificial Sequence: Synthetic polypeptide
QVQLRESGPGLVKSSETLSLTCAVSGGSMGGYYWSWLRHSPVKGLEWIGYVFHTGHTNYNPSLASRVMVSVDTTENQFSLRMRSVTAADTAVYYCASLPRGQLVNAFFDNWGPGTLVTVAS

SEQ ID NO: 42 - protein, 121 aa, Artificial Sequence
  Description of Artificial Sequence: Synthetic polypeptide
QVQLQESGPGVVKSSETLSLTCSVSGGSMGGTYWSWLRLSPGKGLEWIGYIFHTGHTNYSPSLKGRVSISVDTSEDQFSLRLRSVTAADTAVYFCASLPRGQLVNAYFRNWGRGILVSVTA

SEQ ID NO: 43 - protein, 107 aa, Artificial Sequence
  Description of Artificial Sequence: Synthetic polypeptide
  MOD_RES (107)..(107): Any amino acid
SYELTQPPSVSVSPGQTASITCSGDKLGDKYACWYQQKPGQSPVLVIYQDSKRPSGIPERFSGSNSGNTATLTISGTQAMDEADYYCQAWDSFSTFVFGTGTKVTVX

SEQ ID NO: 44 - protein, 107 aa, Artificial Sequence
  Description of Artificial Sequence: Synthetic polypeptide
  MOD_RES (107)..(107): Any amino acid
SYELTQPPSVSVSPGQTATITCSGDKVASKNVCWYQVKPGQSPEVVMYENYKRPSGIPDRFSGSKSGSTATLTIRGTQATDEADYYCQVWDSFSTFVFGSGTQVTVX

SEQ ID NO: 45 - protein, 104 aa, Artificial Sequence
  Description of Artificial Sequence: Synthetic polypeptide
  MOD_RES (104)..(104): Any amino acid
SYELTQPPSVSVSPGQTATITCSGASTNVCWYQVKPGQSPEVVIFENYKRPSGIPDRFSGSKSGSTATLTIRGTQAIDEADYYCQVWDSFSTFVFGSGTQVTVX

SEQ ID NO: 46 - protein, 107 aa, Artificial Sequence
  Description of Artificial Sequence: Synthetic polypeptide
  MOD_RES (107)..(107): Any amino acid
SYELTQPPSVSVSPGQTATITCSGDKVASKNVCWYQVKPGQSPEVVMYENYKRASGIPDRFSGSKSGSTATLTIRGTQATDEADYYCQVWDSFSTFVFGSGTQVTVX

SEQ ID NO: 47 - protein, 107 aa, Artificial Sequence
  Description of Artificial Sequence: Synthetic polypeptide
  MOD_RES (107)..(107): Any amino acid
SYELTQPPSVSVSPGQTATITCSGDKVASVNVCWYQVKPGQSPDVVMYENYKRPSGIPDRFSGSKSGSTATLTIRGTQATDEAEYYCQVWDSFSTFVFGSGTQVTVX

SEQ ID NO: 48 - protein, 846 aa, Human immunodeficiency virus; identical to SEQ ID NO: 15

SEQ ID NO: 49 - protein, 840 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 50 - protein, 840 aa, Human immunodeficiency virus; identical to SEQ ID NO: 49

SEQ ID NO: 51 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLGYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 52 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLPEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 53 - protein, 845 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 54 - protein, 846 aa, Human immunodeficiency virus; identical to SEQ ID NO: 15

SEQ ID NO: 55 - protein, 846 aa, Human immunodeficiency virus; identical to SEQ ID NO: 15

SEQ ID NO: 56 - protein, 846 aa, Human immunodeficiency virus; identical to SEQ ID NO: 15

SEQ ID NO: 57 - protein, 846 aa, Human immunodeficiency virus; identical to SEQ ID NO: 15

SEQ ID NO: 58 - protein, 846 aa, Human immunodeficiency virus; identical to SEQ ID NO: 15

SEQ ID NO: 59 - protein, 846 aa, Human immunodeficiency virus; identical to SEQ ID NO: 15

SEQ ID NO: 60 - protein, 846 aa, Human immunodeficiency virus; identical to SEQ ID NO: 15

SEQ ID NO: 61 - protein, 846 aa, Human immunodeficiency virus; identical to SEQ ID NO: 15

SEQ ID NO: 62 - protein, 846 aa, Human immunodeficiency virus; identical to SEQ ID NO: 15

SEQ ID NO: 63 - protein, 846 aa, Human immunodeficiency virus; identical to SEQ ID NO: 15

SEQ ID NO: 64 - protein, 846 aa, Human immunodeficiency virus; identical to SEQ ID NO: 15

SEQ ID NO: 65 - protein, 846 aa, Human immunodeficiency virus; identical to SEQ ID NO: 15

SEQ ID NO: 66 - protein, 846 aa, Human immunodeficiency virus; identical to SEQ ID NO: 15

SEQ ID NO: 67 - protein, 846 aa, Human immunodeficiency virus; identical to SEQ ID NO: 15

SEQ ID NO: 68 - protein, 846 aa, Human immunodeficiency virus; identical to SEQ ID NO: 15

SEQ ID NO: 69 - protein, 846 aa, Human immunodeficiency virus; identical to SEQ ID NO: 15

SEQ ID NO: 70 - protein, 846 aa, Human immunodeficiency virus; identical to SEQ ID NO: 15

SEQ ID NO: 71 - protein, 846 aa, Human immunodeficiency virus; identical to SEQ ID NO: 15

SEQ ID NO: 72 - protein, 846 aa, Human immunodeficiency virus; identical to SEQ ID NO: 15

SEQ ID NO: 73 - protein, 846 aa, Human immunodeficiency virus; identical to SEQ ID NO: 15

SEQ ID NO: 74 - protein, 846 aa, Human immunodeficiency virus; identical to SEQ ID NO: 15

SEQ ID NO: 75 - protein, 846 aa, Human immunodeficiency virus; identical to SEQ ID NO: 15

SEQ ID NO: 76 - protein, 846 aa, Human immunodeficiency virus; identical to SEQ ID NO: 15

SEQ ID NO: 77 - protein, 846 aa, Human immunodeficiency virus; identical to SEQ ID NO: 15

SEQ ID NO: 78 - protein, 846 aa, Human immunodeficiency virus; identical to SEQ ID NO: 15

SEQ ID NO: 79 - protein, 846 aa, Human immunodeficiency virus; identical to SEQ ID NO: 15

SEQ ID NO: 80 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLLLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 81 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLRRSSLKGLRRGWEALKYLGSLVQYWGLELKRSAISLLDTLAIAVGEGTDRILEFVLGICRAIRNIPTRIRQGFETALL

SEQ ID NO: 82 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQNNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 83 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIRIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 84 - protein, 846 aa, Human immunodeficiency virus; identical to SEQ ID NO: 15

SEQ ID NO: 85 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCAHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 86 - protein, 846 aa, Human immunodeficiency virus; identical to SEQ ID NO: 15

SEQ ID NO: 87 - protein, 846 aa, Human immunodeficiency virus; identical to SEQ ID NO: 15

SEQ ID NO: 88 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTHMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 89 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLEICRAIRNIPTRIRQGFETALL

SEQ ID NO: 90 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNVRRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 91 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVGREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 92 - protein, 846 aa, Human immunodeficiency virus; identical to SEQ ID NO: 15

SEQ ID NO: 93 - protein, 846 aa, Human immunodeficiency virus; identical to SEQ ID NO: 15

SEQ ID NO: 94 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 95 - protein, 846 aa, Human immunodeficiency virus; identical to SEQ ID NO: 94

SEQ ID NO: 96 - protein, 846 aa, Human immunodeficiency virus; identical to SEQ ID NO: 94

SEQ ID NO: 97 - protein, 846 aa, Human immunodeficiency virus; identical to SEQ ID NO: 94

SEQ ID NO: 98 - protein, 846 aa, Human immunodeficiency virus; identical to SEQ ID NO: 94

SEQ ID NO: 99 - protein, 844 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTCNNVSTVQCTHGIKPVISTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLYLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 100 - protein, 840 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 101 - protein, 839 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 102 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDRREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 103 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASLTLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 104 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSIRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARTGELLGRSSLKGLRRGWEALKYLGSLVQYWGLELKRSAISLLDTLAIAVGEGTDRILEFVLGICRAIRNIPTRIRQGFETALL

SEQ ID NO: 105 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSIRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 106 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSARTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 107 - protein, 846 aa, Human immunodeficiency virus; identical to SEQ ID NO: 102

SEQ ID NO: 108 - protein, 846 aa, Human immunodeficiency virus; identical to SEQ ID NO: 106

SEQ ID NO: 109 - protein, 845 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNVKTIIVHLNESVKIECMRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSARTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 110 - protein, 846 aa, Human immunodeficiency virus; identical to SEQ ID NO: 106

SEQ ID NO: 111 - protein, 846 aa, Human immunodeficiency virus; identical to SEQ ID NO: 105

SEQ ID NO: 112 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTQTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 113 - protein, 846 aa, Human immunodeficiency virus; identical to SEQ ID NO: 105

SEQ ID NO: 114 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALKRYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 115 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVISTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFSRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 116 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKISFDPIPIHYCAPAGYAILKCNNQTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNNTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 117 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVISTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 118 - protein, 845 aa, Human immunodeficiency virus
MRVMGIQRNYPQWWIWSMLGFWMLMCNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 119 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSRIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTIIIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGCSSLKGLRRGWEALKYLGSLVQYWGLELKRSAISLLDTLAIAVGEGTDRILEFVLGICRAIRNIPTRIRQGFETALL

SEQ ID NO: 120 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEIITHSFNCGGEFFYCNTSSLFNRTYMANSTDMANSTETNSTRIITIHCRIKQIINMWQEVGRAMYAPPIAGSITCISNITGLLLTRDGGKNNMETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 121 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDRREKKNALFYKLDIVQLDGNSNQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCMSNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 122 - protein, 846 aa, Human immunodeficiency virus; identical to SEQ ID NO: 105

SEQ ID NO: 123 - protein, 846 aa, Human immunodeficiency virus; identical to SEQ ID NO: 105

SEQ ID NO: 124 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDRREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTYMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 125 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRYENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 126 - protein, 846 aa, Human immunodeficiency virus; identical to SEQ ID NO: 102

SEQ ID NO: 127 - protein, 739 aa, Human immunodeficiency virus
MRVMGIQRNYPQWWIWSMLGFWMLMICNGMWVTVYYGVPVWKEAKTTLFCASDTKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALLYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 128 - protein, 739 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 129 - protein, 846 aa, Human immunodeficiency virus
  MOD_RES (46)..(46): Any amino acid
MRVMGIQRNYPQWWIWSMLGFWMLMICNGMWVTVYYGVPVWKEAKXTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSIRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 130 - protein, 846 aa, Human immunodeficiency virus
  MOD_RES (266)..(266): Any amino acid
  MOD_RES (396)..(396): Any amino acid
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITXNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSXRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 131 - protein, 846 aa, Human immunodeficiency virus
  MOD_RES (266)..(266): Any amino acid
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITXNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 132 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 133 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILRCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRTIRNIPTRIRQGFETALL

SEQ ID NO: 134 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIYCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQNNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 135 - protein, 846 aa, Human immunodeficiency virus; identical to SEQ ID NO: 105

SEQ ID NO: 136 - protein, 846 aa, Human immunodeficiency virus; identical to SEQ ID NO: 94

SEQ ID NO: 137 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTQTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPTPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 138 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSRIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 139 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSARTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 140 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTASLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGTDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 141 - protein, 846 aa, Human immunodeficiency virus; identical to SEQ ID NO: 105

SEQ ID NO: 142 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSIRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTETIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 143 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSIRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPKGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 144 - protein, 846 aa, Human immunodeficiency virus; identical to SEQ ID NO: 15

SEQ ID NO: 145 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVISTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGRIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 146 - protein, 846 aa, Human immunodeficiency virus; identical to SEQ ID NO: 139

SEQ ID NO: 147 - protein, 846 aa, Human immunodeficiency virus; identical to SEQ ID NO: 105

SEQ ID NO: 148 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSIRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNLPTRIRQGFETALL

SEQ ID NO: 149 - protein, 846 aa, Human immunodeficiency virus; identical to SEQ ID NO: 105

SEQ ID NO: 150 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSKRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 151 - protein, 839 aa, Human immunodeficiency virus
MRVMGIQRNYPQWWIWSMLGFWMLMICNGMWVTVYYGVPVWKEATTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 152 - protein, 845 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSIRTITIHCRIKQIINMWQEVGRAMYVPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 153 - protein, 846 aa, Human immunodeficiency virus
  MOD_RES (293)..(293): Any amino acid
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDRREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTXIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 154 - protein, 846 aa, Human immunodeficiency virus; identical to SEQ ID NO: 105

SEQ ID NO: 155 - protein, 876 aa, Human immunodeficiency virus
MRVMGIQRNYPQWWIWSMLGFWMLMICNGMWVTVYYGVPVWKEAKTTLSMLGFDANDLWDWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASSSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSPGGDLEITTHSFNCGGEFFYCNTSSLFNRTYMANSTDMANSTETNNTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 156 - protein, 846 aa, Human immunodeficiency virus; identical to SEQ ID NO: 105

SEQ ID NO: 157 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 158 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRYENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNNTRTITIHCRIKQIINMWQEVGRAMYAPPIAGNITCISNITGLLLTRDGGKNNTETFRPGGGNMRDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIIIVGGLIGLRIIFAVLSLVNKVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 159 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKGAVGMGAVFLGFLGAAGSTMGAASITLTVQARQLLSGIVQQQSNLLKAIEAQQHMLKLTVWGIKQLQARVLALERYLKDQQLLGIWGCSGKLICTTNVYWNSSWSNKTYGDIWDNMTWMQWEREISNYTEIIYELLEESQNQQEKNEQDLLALDRWNRLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 160 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 161 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTQTITIHCRIKQIINMWQEVGRAMYAPPIAGNITCISNITRLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 162 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRYENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNNTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 163 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRYENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 164 - protein, 846 aa, Human immunodeficiency virus; identical to SEQ ID NO: 105

SEQ ID NO: 165 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSIRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVNGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 166 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMRKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSIRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 167 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVISTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSIRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 168 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLILTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 169 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNNTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 170 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYVANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 171 - protein, 846 aa, Human immunodeficiency virus
MGVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTQTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGVAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 172 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSIRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 173 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 174 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASLTLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 175 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVMSLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSIRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 176 - protein, 846 aa, Human immunodeficiency virus; identical to SEQ ID NO: 105

SEQ ID NO: 177 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKSTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 178 - protein, 733 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTETNNTRTITIHCRIKQIINMWQEVGRAMYAPPIAGNITCISNITGLLLTRDGGKNNTETFRPGGGNMKDNWRSELYKYKVVEVKPLGVAPTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 179 - protein, 846 aa, Human immunodeficiency virus
  MOD_RES (396)..(396): Any amino acid
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSXRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 180 - protein, 846 aa, Human immunodeficiency virus; identical to SEQ ID NO: 179
  MOD_RES (396)..(396): Any amino acid

SEQ ID NO: 181 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLRRVSKKLKEYFPHKNITFQPSSGGDLEITTHSFNCGGEFFYCNTSSLFNRTYMANSTDMANSTETNSARTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVVGICRAIRNIPTRIRQGFETALL

SEQ ID NO: 182 - protein, 626 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSHTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 183 - protein, 846 aa, Human immunodeficiency virus; identical to SEQ ID NO: 102

SEQ ID NO: 184 - protein, 846 aa, Human immunodeficiency virus; identical to SEQ ID NO: 169

SEQ ID NO: 185 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNNTRTITIHCRIRQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWDWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGERTDRILEFVLGICRAIRNIPTRIRQGFETALL

SEQ ID NO: 186 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITINCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASLTLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 187 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTVTIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 188 - protein, 846 aa, Human immunodeficiency virus; identical to SEQ ID NO: 160

SEQ ID NO: 189 - protein, 846 aa, Human immunodeficiency virus; identical to SEQ ID NO: 139

SEQ ID NO: 190 - protein, 846 aa, Human immunodeficiency virus; identical to SEQ ID NO: 150

SEQ ID NO: 191 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 192 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNNTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 193 - protein, 845 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 194 - protein, 846 aa, Human immunodeficiency virus
MRVMGIQRNYPQWWIWSMLGFWMLMICNGMWVTVYYGVPVWKEAKTTLFCASDTKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLKESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 195 - protein, 846 aa, Human immunodeficiency virus; identical to SEQ ID NO: 160

SEQ ID NO: 196 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITINCRIKQIINMWQEVGRAMYAPPIAGNITCISNITGLILTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 197 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKISFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLKSLVQYWGLELKRSAISLLDTLAIAVGEGTDRILEFVLGICRAIRNIPTRIRQGFETALL

SEQ ID NO: 198 - protein, 846 aa, Human immunodeficiency virus; identical to SEQ ID NO: 102

SEQ ID NO: 199 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMALKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSIRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIRIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 200 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNRLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 201 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNRLWNGFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 202 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTIKIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASVTLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAIGEGTDRILEFVLGICRAIRNIPTRIRQGFETALL

SEQ ID NO: 203 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYVILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTIKIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILKFVLGICRAIRNIPTRIRQGFETALL

SEQ ID NO: 204 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTIKIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILKFVLGICRAIRNIPTRIRQGFETALL

SEQ ID NO: 205 - protein, 846 aa, Human immunodeficiency virus; identical to SEQ ID NO: 204

SEQ ID NO: 206 - protein, 845 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTIKIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILKFVLGICRAIRNIPTRIRQGFETALL

SEQ ID NO: 207 - protein, 846 aa, Human immunodeficiency virus; identical to SEQ ID NO: 204

SEQ ID NO: 208 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTIKIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 209 - protein, 846 aa, Human immunodeficiency virus; identical to SEQ ID NO: 208

SEQ ID NO: 210 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTIKIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDKPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 211 - protein, 846 aa, Human immunodeficiency virus; identical to SEQ ID NO: 208

SEQ ID NO: 212 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTIKIHCRIKQIINMWQEVGRAMYAPPIAGNITCISNITGLLLTRDGGKNNTETFRPGGGNMKDNWRSELYKYKVVEVKPLGVAPTNARRRVVEKEKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 213 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTIKIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKRLRRGWEALKYLGNLVQYWGLELKRSAISLLDTLAIAVGEGTDRILEFVLGICRAIRNIPTRIRQGFETALL

SEQ ID NO: 214 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEEMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTVTIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 215 - protein, 846 aa, Human immunodeficiency virus
MRVMGIQRNYPQWWIWSMLGFWMLMICNGMWVTVYYGVPVWKEAKTTLFCASDTKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 216 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 217 - protein, 846 aa, Human immunodeficiency virus
  MOD_RES (402)..(402): Any amino acid
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIXCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILKFVLRICRAIRNIPTRIRQGFETALL

SEQ ID NO: 218 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQAKVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEDGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 219 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCITLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLSDTLAIAVGEGTDRILEFVLGICRAIRNIPTRIRQGFETALL

SEQ ID NO: 220 - protein, 846 aa, Human immunodeficiency virus; identical to SEQ ID NO: 219

SEQ ID NO: 221 - protein, 846 aa, Human immunodeficiency virus; identical to SEQ ID NO: 219

SEQ ID NO: 222 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIRAAYCNINESKWNETLQRVSKKLKEYFPHKNITFQPSPGGDLEITTHSFNCGGEFFYCNTSSLFNRTYMANSTDMANSTETNNTRTITIHCRIKQIINMWQEVGRAMYAPPIAGNITCISNITGLLLTRDGGKNNAETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 223 - protein, 844 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIRAAYCNINESKWNETLQRVSKKLKEYFPHKNITFQPSPGGDLEITTHSFNCGGEFFYCNTSSLFNRTYMANSTDMANSTETNNTRTITIHCRIKQIINMWQEVGRAMYAPPIAGNITCISNITGLLLTRDGGKNNAETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETA

SEQ ID NO: 224 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMFLKNVTENFNMWKNDMVDQMHEDVISLWDQSLKPCVKLTPLCVTLNCTNATASNSSIIERMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRASIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 225 - protein, 739 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESIKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 226 - protein, 739 aa, Human immunodeficiency virus; identical to SEQ ID NO: 225

SEQ ID NO: 227 - protein, 739 aa, Human immunodeficiency virus
MRVMGIQRNYPQWWIWNMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 228 - protein, 739 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATACNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNNTRTITIHCRIKQIINMWQEVGRAMYAPPIAGNITCISNITGLLLTRDGGKNNTETFRPGGGNMKDNWRSELYKYKVVEVKPLGVAPTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 229 - protein, 840 aa, Human immunodeficiency virus
  MOD_RES (517)..(517): Any amino acid
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANNSNIIEEMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTDMANSTETNNTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVXARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 230 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSNIIEEMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTIKIHCRIKQIINMWQEVGRAMYAPPIAGNITCISNITGLLLTRDGGKNNTETFRPGGGNMKDNWRSELYKYKVVEVKPLGVAPTNARRRVVERKKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILKFVLGICRAIRNIPTRIRQGFETALL

SEQ ID NO: 231 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGAAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGGLVQYWGLELKRSAISLLDTLAIAVGEGTDRILEFVLGICRAIRNIPTRIRQGFETALL

SEQ ID NO: 232 - protein, 845 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDSLKPCVKLTPLCVTLNCTNATANNSSIIEGMKNCSFNITTELRDKREKKNVLFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIVVGEGTDRILEFVLGICRAIRNIPTRIRQGFETALL

SEQ ID NO: 233 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNANASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFTLIAARAGELLGRSSLKGLRRGWEALKYLGSLVQYWGLELKRSAISLLDTLAIAVGEGTDRILEFVLGICRAIRNIPTRIRQGFETALL

SEQ ID NO: 234 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNISIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 235 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLRICRAIRNIPTRIRQGFETALL

SEQ ID NO: 236 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGNIREAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNRLWNWFNITNWLWYIKIFIMIVGGLIGLRIIFAVLSLVNRVRQGYSPLSLQTLIPSPRGPDRPGEIEEEGGEQDRNRSTRLVSGFLALVWDDLRSLCLFIYHRLRDFILIAARAGELLGRSSLKGLRRGWEALKYLGGLVQYWGLELKRSAISLLDTLAIAVGEGTDRILEFVLGICRAIRNIPTRIRQGFETALL

SEQ ID NO: 237 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGNIREAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 238 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNINESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 239 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 240 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNNTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 241 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTIKIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 242 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIRNIREAYCNINESKWNETLQRVSKKLKEYFPHKNITFQPSSGGDLEITTHSFNCGGEFFYCNTSSLFNRTYMANSTDMANSTETNSTRTIKIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 243 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGNIREAYCNINESKWNETLQRVSKKLKEYFPHKNITFQPSSGGDLEITTHSFNCGGEFFYCNTSSLFNRTYMANSTDMANSTETNSTRTIKIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDKWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 244 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNINESKWNETLQRVSKKLKEYFPHKNITFQPSSGGDLEITTHSFNCGGEFFYCNTSSLFNRTYMANSTDMANSTETNNTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRRGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 245 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 246 - protein, 845 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNAASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNINESKWNETLQRVSKKLKEYFPHKNITFQPSSGGDLEITTHSFNCGGEFFYCNTSSLFNRTYMANSTDMANSTETNNTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 247 - protein, 845 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNAASNSSIIEGMKNCSFNITTELRDKREKKNALFYKLDIVQLDGNSSQYRLINCNTSVITHACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNINESKWNETLQRVSKKLKEYFPHKNITFQPSSGGDLEITTHSFNCGGEFFYCNTSSLFNRTYMANSTDMANSTETNNTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 248 - protein, 844 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTEDFNMWKNDMVDQMHEDVISLWDQSLKPCVKLTPLCVTLNCTNANASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFTLIAARAGELLGRSSLKGLRRGWEALKYLGSLVQYWGLELKRSAISLLDTLAIAVGEGTDRILEFVLGICRAIRNIPTRIRQGFETALL

SEQ ID NO: 249 - protein, 851 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRKSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 250 - protein, 851 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRKSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 251 - protein, 851 aa, Human immunodeficiency virus; identical to SEQ ID NO: 250

SEQ ID NO: 252 - protein, 851 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNATASNSSIIEGMKNCSFNITTELRDRREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRAAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 253 - protein, 853 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNTNATASNSSIIEGMKNCSFNITTELRDRREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 254 - protein, 853 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNTNATASNSSTIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGNIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWIQWEREISNYTEIIYELLEESQNQQEKNEQDLLALDRWNSLWNWFNITNWLWYIKIFIMIVGGLIGLRIIFAVLSLANRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 255 - protein, 853 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNTNATANNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAVYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 256 - protein, 851 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAHCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 257 - protein, 851 aa, Human immunodeficiency virus; identical to SEQ ID NO: 256

SEQ ID NO: 258 - protein, 849 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 259 - protein, 849 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGSCNNVSTVQCTHGIKPVVSTQLLLNGSLAEGEIIIRSENITNNGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRTIRNIPTRIRQGFETALL

SEQ ID NO: 260 - protein, 849 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGSCNNVSTVQCTHGIKPVVSTQLLLNGSLAEGEIIIRSENITNNGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 261 - protein, 849 aa, Human immunodeficiency virus; identical to SEQ ID NO: 258

SEQ ID NO: 262 - protein, 850 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNEPVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIVVGEGTDRILEFVLGICRAIRNIPTRIRQGFETALL

SEQ ID NO: 263 - protein, 850 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNVTTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 264 - protein, 850 aa, Human immunodeficiency virus
MRVMGIQRNHPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 265 - protein, 850 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPSNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKTNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAITVGEGTDRILEFVLGICRAIRNIPTRIRQGFETALL

SEQ ID NO: 266 - protein, 849 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNISESKWNETLQRVSKKLKEYFPHKNITFQPSSGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYSDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLWRGWEALKYLGSLVQYWGLELKRSAISLLDTLAIAVGEGTDRILEFVLGICRAIRNIPTRIRQGFETALL

SEQ ID NO: 267 - protein, 846 aa, Human immunodeficiency virus
MRVMGIQRNYPQWWIWSMLGFWMLMICNGMWVTVYYGVPVWKEAKTTLFCASDAKAYEKEVHNVWATYACVPTDPNPQEMVLKNVTENFNMWKNDMVDQMHEDVISLWDQSLKPCVKLTPLCVTLNCTNATAGNSSIIEEMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIRQIINMWQEVGRAMYAPPIAGNITYISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGGLVQYWGLELKRSAISLLDTLAIAVGEGTDRILEFVLGICRAIRNIPTRIRQGFETALL

SEQ ID NO: 268 - protein, 845 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSTISLLDTLAIAVGEGTDRILEFVLGICRAIRNIPTRIRQGFETALL

SEQ ID NO: 269 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEEMKNCSFNIITELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRNITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 270 - protein, 849 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGSCNNVSTVQCTHGIKPVVSTQLLLNGSLAEGEIIIRSENITNNGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLSIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 271 - protein, 845 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIEGMKNCSFNITTELRDKREKKNAPFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSKRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 272 - protein, 851 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 273 - protein, 834 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPSNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 274 - protein, 841 aa, Human immunodeficiency virus
MRVMGIQRNYPQWWIWSMLGFWMLMICKGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASISVIEEMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNVKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTETNSTRTITIRCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAIGEGTDRILEFVLGICRAIRNIPTRIRQGFETALL

SEQ ID NO: 275 - protein, 857 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 276 - protein, 849 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPSNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRNITIHCRIKQIINMWQEVGRAMYAPPIAGNITCISNITGLLLTRDGGKNDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFILGICRAIRNIPTRIRQGFETALL

SEQ ID NO: 277 - protein, 851 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGSCNNVSTVQCTHGIKPVVSTQLLLNGSLAEGEIIIRSENITDNGKTIIVHLNESVKIECTRPNNKTRTSIRIGPGQAFYATGQVIGDIKEAYCNISESKWNETLQRVSKKLKEYFPHKNITFQPSSGGDLEITTHSFNCGGEFFYCNTSSLFNRTYMANSTDMANSTETNSTRNITIHCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAIGEGTDRILEFVLGICRAIRNIPTRIRQGFETALL

SEQ ID NO: 278 - protein, 852 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPSNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAITVGEGTDRILEFVLGICRAIRNIPTRIRQGFETALL

SEQ ID NO: 279 - protein, 852 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPSNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKVFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAITVGEGTDRILEFVLGICRAIRNIPTRIRQGFETALL

SEQ ID NO: 280 - protein, 851 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPSNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAITVGEGTDRILEFVLGICRAIRNIPTRIRQGFETALL

SEQ ID NO: 281 - protein, 852 aa, Human immunodeficiency virus; identical to SEQ ID NO: 278

SEQ ID NO: 282 - protein, 852 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAHCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNNLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 283 - protein, 850 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEEMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNTAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGENNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 284 - protein, 850 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNPETFRPGGGNMKDNWRSELYKYKVVEVKPLGVAPTNARRRVVEREKRAVGLGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIVVGEGTDRILEFVLGICRAIRNIPTRIRQGFETALL

SEQ ID NO: 285 - protein, 850 aa, Human immunodeficiency virus
  MOD_RES (320)..(320): Any amino acid
  MOD_RES (404)..(405): Any amino acid
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNNVKTIIVHLNESVKIECTRPNNKTRTSIRIGPGQAFYATGQVIGDIREAXCNISESKWNETLQRVSKKLKEYFPHKNITFQPSSGGDLEITTHSFNCGGEFFYCNTSSLFNRTYMANSTDMANSTETNSTRTIXXHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 286 - protein, 852 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNNVKTIIVHLNESVKIECTRPNNKTRTSIRIGPGQAFYATGQVIGDIREAHCNISESKWNKTLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRRWEALKYLGSLVQYWGLELKRSAISLLDTLAIAIGEGTDRILEFVLGICRAIRNIPTRIRQGFETALL

SEQ ID NO: 287 - protein, 852 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTIKIHCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWLNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 288 - protein, 852 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATANATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVQLNESVKIECTRPNNKTRTSIRIGPGQAFYATGQVIGNIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 289 - protein, 853 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGNIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 290 - protein, 853 aa, Human immunodeficiency virus; identical to SEQ ID NO: 289

SEQ ID NO: 291 - protein, 853 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGNIREAYCNISESKWNETLQRVSKKLKEYFPHKNITFQPSSGGDLEITTHSFNCGGEFFYCNTSSLFNRTYMANSTDMANSTETNSTRTITIPCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILKFVLGICRAIRNIPTRIRQGFETALL

SEQ ID NO: 292 - protein, 853 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPSNKTRTSIRIGPGQAFYATGQVIGDIREAHCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 293 - protein, 853 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMGLKNVTENFNMWKNDMVDQMHEDVISLWDQSLKPCVKLTPLCVTLNCTNATASNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAHCNISESKWNETLQRVSKKLKEYFPHQNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILITARAGELLGRSSLKGLRRGWEALKYLGSLVQYWGLELKRSAISLLDTLAIAVGEGTDRILEFVLGICRAIRNIPTRIRQGFETALL

SEQ ID NO: 294 - protein, 852 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNATASNSSIIKGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGEGNMKDNRSKLYKYKVVEVKPLGVAPTNARRRVVKREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYKLLEESQNQQEKNEQDLLALDRWNSLWNWFNITNWLWYIKIFIMIVGGLIGLKIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILKFVLGICRAIRNIPTRIRQGFETALL

SEQ ID NO: 295 - protein, 853 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPSNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILKFVLGICRAIRNIPTRIRQGFETALL

SEQ ID NO: 296 - protein, 847 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATSNSSIIEEMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNNTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAIGEGTDRILEFVLGICRAIRNIPTRIRQGFETALL

SEQ ID NO: 297 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTSNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPNNNTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 298 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKMTPLCVTLNCTNATAINSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPNNKTRTSIRIGPGQAFYATGQVIGDIREAHCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKSYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 299 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKMTPLCVTLNCTNATAINSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNNTRPITIHCRIKQIINMWQEVGRAMYAPPIAGNITCISNITGLLLTRDGGKNNTETFRPGGGNMKDNWRSELYKYKVVEVKPLGIAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 300 - protein, 854 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATARNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNSGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISSITGLLLTRDGGENNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVFSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 301 - protein, 858 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSINCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNGKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEKDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 302 - protein, 827 aa, Human immunodeficiency virus
MRVMGIQRNYPQWWIWSMLGFWMLMICKGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNISIIEEMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNVKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVEVKPLGVAPTNARRRVVEREKRAVGMGAVFLGFLGAAGSTMGAASITLTVQARQLLSGIVQQQKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAIGEGTDRILEFVLGICRAIRNIPTRIRQGFETALL

SEQ ID NO: 303 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRTITLHCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 304 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRTITLHCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKCLGSLVQYWGLELKRSAISLLDTLAIAVGEGTDRILEFVLGICRAIRNIPTRIRQGFETALL

SEQ ID NO: 305 - protein, 846 aa, Human immunodeficiency virus; identical to SEQ ID NO: 303

SEQ ID NO: 306 - protein, 846 aa, Human immunodeficiency virus
  MOD_RES (724)..(724): Any amino acid
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRTITLHCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQXRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 307 - protein, 854 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATAINISIIEEMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPNNNTRTSIRIGPGQAFYATGQVIGDIREAHCNISESKWNETLQRVSKKLKEYFPHKNITFQPSSGGDLEITTHSFNCGGEFFYCNTSSLFNRTYMVNSTDMANSTETNSTRTITIRCRIKQIINMWQEVGRAMYAPPIAGNITCISNITGLLLTRDGGNNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 308 - protein, 675 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVITQACPKVSFDPIPIHMANSTDTNSTRIITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLYIKIFIMIVGGLIGLRIIFAVFSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLGQYWGLELKRSAISLLDTLAIAVGEGTDRILEFVLGICRAIRNIPTRIRQGFETALL

SEQ ID NO: 309 - protein, 853 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTETIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 310 - protein, 848 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATAINSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNNAKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRIITIRCRIKQIINMWQEVGRAMYAPPIAGNITCISNITGLLLTRDGGKNNTETFETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 311 - protein, 851 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTTANATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAVRAGELLGRSSLKGLRRGWEALKYLGSLVQYWGLELKRSAISLLDTLAIAVGEGTDRILEFVLGICRAIRNIPTRIRQGFETALL

SEQ ID NO: 312 - protein, 846 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRTITIRCRIKQIINMWQEVGRAMYAPPIAGNITCISNITGLLLTRDGGENNTETFETFRPGGGNMKDNWRSELYKYKVVEVKPLGVAPTNARRRAVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILKFVLGICRAIRNIPTRIRQGFETALL

SEQ ID NO: 313 - protein, 859 aa, Human immunodeficiency virus
MRVMGIQRNYPQWWIWSMLGLWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISENKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRKRSTRLVSGFLALVWDDLRSLCLFIYHRLRDFILIAARAGELLGRSSLKGLRRGWEALKYLGSLVQYWGLELKRSAISLLDTLAIAVGEGTDRILEFALGICRAIRNIPTRIRQGFETALL

SEQ ID NO: 314 - protein, 850 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNATASNSSIIEEMKNCSFNITTELRDKREKKNALFYKLDIVQLDGNSSQYRLINCNTSAITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRIITIHCRIKQIINMWQEVGRAMYAPPIAGNITCISNITGLLLTRDGGNNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKGSAISLLDTLAIAVGEGTDRILEFVLGICRAIRNIPTRIRQGFETALL

SEQ ID NO: 315 - protein, 859 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 316 - protein, 851 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTTANATASNSSIIEGMKNCSFNITTELRDKREKKNALFYKLDIVQLDGNSSQYRLINCNTSAITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPQKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 317 - protein, 850 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTTANATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQEREISNYTELIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAVRAGELLGRSSLKGLRRGWEALKYLGSLVQYWGLELKRSAISLLDTLAIAVGEGTDRILEFVLGICRAIRNIPTRIRQGFETALL

SEQ ID NO: 318 - protein, 850 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRIITIRCRIKQIINMWQEVGRAMYAPPIAGNITCISNITGLLLTRDGGNNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIGAQQHMLKLTVWGIKQLQARVLALERYLKDQQLLGMWGCSGKLICTTNVYWNSSWSNKTYGDIWDNMTWMQWEREISNYTEMIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRKRSTRLVSGFLALVWDDLRSLCLFIYHRLRDFILIAARAGELLGRSSLKGLRRGWEALKYLGSLVQYWGLELKRSAISLLDTLAIAVGEGTDRILEFALGICRAIRNIPTRIRQGFETALL

SEQ ID NO: 319 - protein, 859 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 320 - protein, 859 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENIIDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 321 - protein, 845 aa, Human immunodeficiency virus
MRVMGIQRNYPQWWIWSMLGLWMLMICNGMWVTVYYGVPVWKEAKTTLFCASDAKAYEKEVHNVWATHACVPTDPNPQEMVLKNVTENFNRWKNDMVDQMHEDVISLWDQSLKPCVKLTPLCVTLNCTDANATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSNLKGLRRGWEALKYLGSLVQYWGLELKRSAISLLDTLAIAVGEGTDRILEFVLGICRAIRNIPTRIRQGFETALL

SEQ ID NO: 322 - protein, 859 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRTMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEKIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 323 - protein, 859 aa, Human immunodeficiency virus; identical to SEQ ID NO: 315

SEQ ID NO: 324 - protein, 842 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLRSLVQYWGLELKRSAISLLDTLAIAVGEGTDRILEFVLGICRAIRNIPTRIRQGFETALL

SEQ ID NO: 325 - protein, 862 aa, Human immunodeficiency virus
MRVMGRQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISDYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 326 - protein, 859 aa, Human immunodeficiency virus
MRVMGRQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKLLGMWGCSGKLICTTNVYWNSSWSNKTYGDIWDNMTWMQWEREISDYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 327 - protein, 862 aa, Human immunodeficiency virus; identical to SEQ ID NO: 325

SEQ ID NO: 328 - protein, 859 aa, Human immunodeficiency virus
MRVMGIQRNYPQWWIWSMLGLWMLMICNGMWVTVYYGVPVWKEAKTTLFCASDAKAYEKEVHNVWATHACVPTDPNPQEMVLKNVTENFNMWKNDMADQMHEDVINLWDQSLKPCVKLTPLCVTLNCTDATASNATASNATASNSSINSSIIEEMKNCSFNITTELRDKREKKNALFYKLDIVQLDGNSSQYRLINCNTSAITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEVTTHSFNCGGEFFYCNTSSLFNRTDMANSTETNSTRIITIRCRIKQIVNMWQEVGRAMYAPPIAGNITCISNITGLLLTRDGGENNGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGGLVQYWGLELKRSAISLLDTLAIAVGEGTDRILEFVLGICRAIRNIPTRIRQGFETALL

SEQ ID NO: 329 - protein, 859 aa, Human immunodeficiency virus
MRVMGIQRNYPQWWIWSMLGLWMLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCTDATASNATASNATASNSSINSSIIEEMKNCSFNITTELRDKREKKNALFYKLDIVQLDGNSSQYRLINCNTSAITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEVTTHSFNCGGEFFYCNTSSLFNRTDMANSTETNSTRIITIRCRIKQIVNMWQEVGRAMYAPPIAGNITCISNITGLLLTRDGGENNGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGGLVQYWGLELKRSAISLLDTLAIAVGEGTDRILEFVLGICRAIRNIPTRIRQGFETALL

SEQ ID NO: 330 - protein, 860 aa, Human immunodeficiency virus
MRVMGIQRNYPQWWIWSMLGFWTLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCTDATASNATASNATASNTTASNSNIIEEMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEVTTHSFNCGGEFFYCNTSSLFNRTDMANSTETNSTRIITIRCRIKQIVNMWQEVGRAMYAPPIAGNITCISNITGLLLTRDGGENNGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGGLVQYWGLELKRSAISLLDTLAIAVGGGTDRILEFVLGICRAIRNIPTRIRQGFETALL

SEQ ID NO: 331 - protein, 859 aa, Human immunodeficiency virus
MRVMGIQSNYPQWWIWSMLGLWMLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCTDATTNATASNATASNATASNSSIIEGMKNCSFNITTELRDKTEKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEVTTHSFNCGGEFFYCNTSSLFNRTDMANSTETNSTRIITIRCRIKQIINMWQEVGRAMYAPPIAGNITCISNITGLLLTRDGGKNNEGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYDLLEESQNQQEKNEQDLLALDKWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAVRAGELLERSSLKGLRRGWEALKYLGGLVQYWGLELKRSAISLLDTLAIAVGEGTDRILEFVLGICRAIRNIPTRIRQGFETALL

SEQ ID NO: 332 - protein, 855 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLTPCVKLTPLCVTLNCTDATASNATASNATASNATASSSSIIEEMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDPEITTHSFNCGGEFFYCNTSSLFDRTYMANSTETNSTRIITIRCRIKQIINMWQEVGRAMYAPPIAGNITCISNITGLLLTRDGGNSSTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLAFAWDDLRSLCLFIYHRLRDFILIAARAGELLGRSSLKGLRRGWEALKYLGGLVQYWGLELKKSAISLLDTLAIAVGEGTDRILEFVLGICRAIRNIPTRTRQGFETALL

SEQ ID NO: 333 - protein, 859 aa, Human immunodeficiency virus
MRVMGRQRNYPQWWIWSMLGLWMLMICNGMWVTVYYGVPVWKEAKTTLFCASDAKAYEKEVHNVWATHACVPTDPNPQEMVLKNVTENFNMWKNDMVDQMHEDVISLWDQSLTPCVKLTPLCVTLNCTDATASNATASNATASNATASNSSIIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPNKNITFQPSSGGDLEITTHSFNCGGEFFYCNTSSLFNRTYMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLRLTVWGIKQLQARVLALERYLKDQQLLGMWGCSGKLICTTNVYWNSSWSNKTYGDIWDNMTWMQWEREISNYTETIYELLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRKRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 334 - protein, 862 aa, Human immunodeficiency virus
MRVMGIQRNYPQWWIWGMLGFWMLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCITLNCTDATASNATASNATASNATASSIIEGMKNCSFNITTELRDKIEKRNALFYKLDIVQLDGNSSQYRLINCNTSVITQACPKVSFDPIPIHYCAPAGYAILKCNNKTFNGTGPCNNVSTVQCTHGIKPVVSTQLLLNGGLAEGEIIIRSENITDNGKTIIVHLNESVKIECTRPSNNTRTSIRIGPGQAFYATGQVIGDIREAHCNISESKWNETLQRVSEKLKEYFPNKNITFQPSSGGDLEITTHSFNCGGEFFYCNTSSLFNRTYMANSTDMANSTETNSTRIITIRCRIKQIINMWQEVGRAMYAPPIAGNITCISNITGLLLTRDGGKNNTETFETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEMIYELLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRERSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 335 - protein, 864 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNATASNATASNSSILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPQKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGENNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTETIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALP

SEQ ID NO: 336 - protein, 865 aa, Human immunodeficiency virus
MRVMGRQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLTPCVKLTPLCVTLNCTDATASNATASNATASNATASNSSIIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPNKNITFQPSSGGDLEITTHSFNCGGEFFYCNTSSLFNRTYMANSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEMIYELLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRKRSTRLVSGFLALAWDDLRSLCLFIYHRLRDFILIAARAGELLGRSSLKGLRRGWEALKYLGSLVQYWGRELKRSAISLLDTLAIAVGEGTDRILEFALRICRAIRNMPTRIRQGFETALL

SEQ ID NO: 337 - protein, 863 aa, Human immunodeficiency virus
MRVMGIQRNYPQWWIWSMLGLWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNATASNATASNSSIIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPQKNITFQPSSGGDLEITTHSFNCGGEFFYCNTSSLFNRTYMANSTDMANSTETNRTITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEMIYELLEESQNQQEKNEQDLLALDRWNSLWNWFNITKWLWYIKIFIMIVGGLICLRIIFAVLSLVNRVRQGYSPLSLQTLIPSPRGPDRPGGIEEEGGEQDRKRSTRLVSGFLALVWDDLRSLCLFIYHRLRDFILIAARAGELLGRSSLKGLRRGWEALKYLGSLVQYWGLELKRSAISLLDTLAIAVGEGTDRILEFALGICRAIRNIPTRIRQGFETALL

SEQ ID NO: 338 - protein, 862 aa, Human immunodeficiency virus
MRVMGRQRNYPQWWIWSMLGLWMLMICNGMWVTVYYGVPVWKEAKTTLFCASDAKAYEKEVHNVWATHACVPTDPNPQEMVLKNVTENFNMWKNDMVDQMHEDVISLWDQSLTPCVKLTPLCVTLNCTDATASNATASNATASNATASNSSIIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPNKNITFQPSSGGDLEITTHSFNCGGEFFYCNTSSLFNRTYMFNSTDMANSTETNSTRIITIRCRIKQIINMWQEVGRAMYAPPIAGNITCISNITGLLLTRDGGNSSTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEGEISNYTEIIYKLLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRKRSTRLVSGFLALAWDDLRSLCLFIYHRLRDFILIAARAGELLGRSSLKGLRRGWEALKYLGSLVQYWGRELKRSAISLLDTLAIAVGEGTDRILEFALGICRAIRNIPTRIRQGFETALL

SEQ ID NO: 339 - protein, 861 aa, Human immunodeficiency virus
MRVMGIQRNYPQWWIWSMLGLWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCADATTNATASNATASNATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPLKNITFQPSSGGDLEITTHSFNCGGEFFYCNTSSLFNRTYMANSTDMANSTETNSTRIITIRCRIKQIINMWQEVGRAMYAPPIAGNITCISNITGLLLTRDGGNNTNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGGLVQYWGLELKRSAISLLDTLAIAVGEGTDRILEFVLGICRAIRNIPTRIRQGFETALL

SEQ ID NO: 340 - protein, 868 aa, Human immunodeficiency virus
MRVMGIQRNYPQWWIWSMLGLWMLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCTDANATASNTNATASNINATASNSSIIEGMKNCSFSITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLEEYFPHKDITFQPSSGGDLEVTTHSFNCGGEFFYCNTSSLFNRTYMANSTDMANSTETNSTRIITIRCRIKQIINMWQEVGRAMYAPPIAGNITCISNITGLLLTRDGGKNRDRGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGGLVQYWGLELKRSAISLLDTLAIAVGEGTDRILEFVLGICRAIRNIPTRIRQGFETALL

SEQ ID NO: 341 - protein, 856 aa, Human immunodeficiency virus
MRVMGIQRNYPQWWIWSMLGLWMLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCTDANATASNTNATASNINATASDSSIIEGMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSKKLKEYFPHKNITFQPSSGGDLEVTTHSFNCGGEFFYCNTSSLFNRTYMANSTETNSTRTITLHCRIKQIINMWQEVGRAMYAPPIAGNITCISNITGLLLTRDGGNNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 342 - protein, 848 aa, Human immunodeficiency virus
MRVTGIQRNYPQWWIWSMLGLWMLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCIDANATASNATASNSSIIEGMKNCSFNITTELRDKIEKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSKKLKEYFPHKNITFQPSSGGDLEITTHSFNCGGEFFYCNTSSLFNRTYMANSTETNSTRTITLHCRIKQIINMWQEVGRAMYAPPIAGNITCISNITGLLLTRDGGNNNTTETFRPGGGNMKDNWRSELYKYKVVEIKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISDYTEIIYELLEESQNQQEKNEQDLLALDRWNSLWNWFNITNWLWYIKIFIMIVGGLIGLRIIFAVLSLVNRVRQGYSPLSLQTLTPSPRGPDRPGGIEEEGGEQDRNRSTRLVSGFLALAWDDLRSLCLFIYHRLRDFILIAARAGELLGRSSLKGLRRGWEALKYLGGLVQYWGLELKRSAISLLDTLAIAVGEGTDRILEFVLGICRAIRNIPTRIRQGFETALL

SEQ ID NO: 343 - protein, 845 aa, Human immunodeficiency virus
MRVMGIQRNYTQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCANATNATASNSSILEEMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPDKNITFQPSSGGDLEITTHSFNCGGEFFYCNTSSLFNRTYMANSTETNSTRIITIHCRIKQIINMWQEVGRAMYAPPIAGNITCISNITGLLLTRDGGNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 344 - protein, 849 aa, Human immunodeficiency virus
MRVMGIQRNYPQWWIWSMLGFWMLMICNGMWVTVYYGVPVWKEAKTTLFCASDAKAYEKEVHNVWATHACVPTDLNPQEMVLKNVTENFNMWKNDMVDQMHEDVISLWDQSLKPCVKLTPLCVNATASNATASNSSILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPQKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGENNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAKEAQQHMLKLTVWGIKQLQARVLALERYLKDQQLLGMWGCSGKLICTTNVYWNSSWSNKTYGDIWDNMTWMQWEREISNYTETIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 345 - protein, 852 aa, Human immunodeficiency virus
MRVMGIQRNYTQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATASNSSILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKIIIVHLNESVKIECTRPSNNTRTSIRIGPGQAFYATGQVIGDIREAHCNISESKWNETLQRVSKKLKEYFPDKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGENNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 346 - protein, 852 aa, Human immunodeficiency virus
MRVMGIQRNYTQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATASNSSILEGMKNCSFNITIELRDKREKKNALFYKLDIVQLGGNSSQYRLINCNTSVITQACPKVSFDPIPIHYCAPAGCAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPDKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGENNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 347 - protein, 852 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLDCINATNATASNSSILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPDKNITFQPSSGGDLEITTHSFNCGGEFFYCNTSSLFNRTYMVNSTDMANSTETNSTRTITIRCRIKQIINMWQEVGRAMYAPPIAGNITCISNITGLLLTRDGGENNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 348 - protein, 851 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVRLTPLCVTLNCINATNATASNSSILEGMKNCSFNITTELRDKREKKNALFYKLDIVQLDGNSSQYRLINCNTSVITACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPDKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGENNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEKEISNYTELIYELLEESQNQQEKNEQDLLALDRWNSLWNWFNITNWLWYIKIFIMIVGGLIGLRIIFAALSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 349 - protein, 852 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVRLTPLCVTLNCINATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPDKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGENNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 350 - protein, 852 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVRLTPLCVTLNCINATNATASNNSILEGMKNCSFNIATELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGNIREAHCNISESKWNETLQRVSKKLKEYFPDKNITFQPSSGGDLEITTHSFSCGGEFFYCNTSSLFNRTYMATNTDMANSTETNSTRIITIRCRIRQIINMWQEVGRAMYAPPIAGNITCISNITGLLLTRDGGENNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 351 - protein, 849 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLSCTNATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNDTDTFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGNLVQYWGLELKRSAISLLDTLAIAVGEGTDRILEFVLGICRAIRNIPTRIRQGFETALL

SEQ ID NO: 352 - protein, 851 aa, Human immunodeficiency virus
MRVRGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLSCTNATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 353 - protein, 851 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWEQSLKPCVKLTPLCVTLNCINATNATASNSSILEGMKNCSFNITTELRDKREKKNALFYKLDIVQLDGNSSQYRLINCNTSAITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPHKNITFQPSSGGDLEVTTHSFNCGGEFFYCNTSSLFNRTYMATSTDMANSTETNSTRIITIRCRIKQIINMWQEVGRAMYAPPIAGNITCISNITGLLLTRDGGKNDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQGYSPLSFQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 354 - protein, 853 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCIDATASNATAINISIIEEMKNCSFNITTELRDKREKKNALFYKLDIVQLDGNSSQHRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGNIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 355 - protein, 853 aa, Human immunodeficiency virus; identical to SEQ ID NO: 354

SEQ ID NO: 356 - protein, 853 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCIDATASNATAINISIIEEMKNCSFNITTELRDKREKKNALFYKLDIVQLDGNSSQHRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGNIREAHCNISKSKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEKEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 357 - protein, 858 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMGKNDMVDQMHEDVISLWDQSLKPCVKLTPLCVTLNCTDANATASNSSIIEGMNSSILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 358 - protein, 859 aa, Human immunodeficiency virus
MRVMGIQRNYTQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNVNATASNSSIIEGMNSSILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPDKNITFQPSSGGDLEITTHSFNCGGEFFYCNTSSLFNRTYMANSTDMANSTETNSTRIITIRCRIKQIINMWQEVGRAMYAPPIAGNITCISNITGLLLTRDGGENNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWDWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 359 - protein, 859 aa, Human immunodeficiency virus; identical to SEQ ID NO: 358

SEQ ID NO: 360 - protein, 859 aa, Human immunodeficiency virus; identical to SEQ ID NO: 358

SEQ ID NO: 361 - protein, 859 aa, Human immunodeficiency virus
MRVMGRQRNYPQWWIWSMLGFWMLMICNGMWVTVYYGVPVWKEAKTTLFCASDAKAYEKEVHNVWATHACVPTDPNPQEMVLKNVTEKFNMWKNDMVDQMHEDVISLWDQSLKPCVKLTPLCVTLNCTNVNATASNSSIIEGMNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPQKNITFQPSSGGDLEITTHSFNCGGEFFYCNTSSLFNRTYMANSTDMANSTETNSTRIITIRCRIKQIINMWQEVGRAMYAPPIAGNITCISNITGLLLTRDGGENNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEKIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFTLIAARAGELLGRSSLKGLWRGWEALKYLGSLVQYWGLELKRSAISLLDTLAIAVGEGTDRILEFVLGICRAIRNIPTRIRQGFETALL

SEQ ID NO: 362 - protein, 849 aa, Human immunodeficiency virus
RVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVRLTPLCVTLNCINATNATASKSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGNIREAHCNISESKWNETLQRVSEKLKEYFPHKNITFQPSSGGDLEITTHSFNCGGEFFYCNTSSLFNRTYMVNSTDMANSTETNSTRTITISCRIKQIINMWQEVGRAMYAPPIAGNITCISNITGLLLTRDGGNDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARVGELLGRNSLKGLRRGWEALKYLGSLVQYWGLELKRSAISLLDTLAIAVGEGTDRILEFVLGICRAIRNIPTRIRQGFETALL

SEQ ID NO: 363 - protein, 851 aa, Human immunodeficiency virus
MRVRGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGNIREAHCNISESKWNETLQRVSEKLKEYFPHKNITFQPSSGGDLEITTHSFNCRGEFFYCNTSSLFNRTYMATSTDMANSTETNSTRIITIRCRIKQIINMWQEVGRAMYAPPIAGNITCISNITGLLLTRDGGENDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYSDIWDNMTWMQWEREISNYTELIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 364 - protein, 850 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGNIREAHCNISESKWNETLQRVSEKLKEYFPQKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGNDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 365 - protein, 850 aa, Human immunodeficiency virus
MRVRGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVRLTPLCVTLNCINATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPDKNITFQPSSGGDLEITTHSFNCGGEFFYCNTSSLFNRTYMANSTDMANSTETNSTRIITLHCRIKQIINMWQEVGRAMYAPPIAGNITCISNITGLLLTRDGGNDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEGGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 366 - protein, 851 aa, Human immunodeficiency virus
MRVRGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVRLTPLCVTLNCINATNATASNSNILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPDKNITFQPSSGGDLEITTHSFNCGGEFFYCNTSSLFNRTYMANSTDMANSTETNSTRIITLHCRIKQIINMWQEVGRAMYAPPIAGNITCISNITGLLLTRDGGKNDTDTETFRPEGGNMKDNWRSELYKYKVVEVKPLGVAPTNARRRVVEREKRAVGMGAVFLGLLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLQRGWEALKYLGSLVQYWGLELKRSAISLLDTLAIAVGEGTDRILEFVLGICRAIRNIPTRIRQGFETALL

SEQ ID NO: 367 - protein, 850 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVRLTPLCVTLNCINATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPDKNITFQPSSGGDLEITTHSFNCGGEFFYCNTSSLFNRTYMATNTDMANSTETNSTRIITIRCRIKQIINMWQEVGRAMYAPPIAGNITCISNITGLLLTRDGGNDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 368 - protein, 851 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVRLTPLCVTLNCINATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISERKWNETLQRVSEKLKEYFPDKNITFQPSSGGDLEITTHSFNCGGEFFYCNTSSLFNRTYMVNSTDMANSTETNSTRTITISCRIKQIINMWQEVGRAMYAPPIAGNITCISNITGLLLTRDGGKNDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 369 - protein, 851 aa, Human immunodeficiency virus
MRVMGIQRSYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVRLTPLCVTLNCINATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPDKNITFQPSSGGDLEITTHSFNCGGEFFYCNTSNLFNRTYMVNSTDMANSTETNSTRTITISCRIKQIINMWQEVGRAMYAPPIAGNITCISNITGLLLTRDGGKNDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 370 - protein, 851 aa, Human immunodeficiency virus
MRVMGRQRNYPQWWIWSMLGLWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPDKNITFQPSSGGDLEITTHSFNCGGEFFYCNTSSLFNRTYMVNSTDMANSTETNSTRTITISCRIKQIINMWQEVGRAMYAPPIAGNITCISNITGLLLTRDGGKNDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 371 - protein, 851 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATNATASNSSILGGMKNCSFNITTELRDKREKKNALFYKLDIVQLDGNSSQYRLINCNTSAITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPDKNITFQPSSGGDLEITTHSFNCGGEFFYCNTSSLFNRTYMANSTDMANSTETNSTRIITIRCRIKQIINMWQEVGRAMYAPPIAGNITCISNITGLLLTRDGGKNDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 372 - protein, 858 aa, Human immunodeficiency virus
MRVMGIQKNCPQWWIWSMLGLWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDANATASNSSIIKGMNSSMIEEMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPQKDITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGENDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLKDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 373 - protein, 858 aa, Human immunodeficiency virus
MRVRGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDANATASNSSIIKGMNSSMIEEMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPDKNITFQPSSGGDLEITTHSFNCGGEFFYCNTSSLFNRTYMANSTDMANSTETNSTRIITLHCRIKQIINMWQEVGRAMYAPPIAGNITCISNITGLLLTRDGGKNDTDTETFRPVGGNMKDNWRSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 374 - protein, 856 aa, Human immunodeficiency virus
MRVMGIQRNYPQWWIWSMLGLWMLMICNGMWVTVYYGVPVWKKAKTTLFCASDAKAYEKEVHSVWATHACVPTDPNPQEMVLKNVTENFNMWKNDMVDQMHEDVISLWDQSLKPCVKLTPLCVTLNCTDANATASNSSIIKGMNSSMIEEMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSKKLKEYFPDRNITFQPSSGGDPEITTHSFNCGGKFFYCNTSSLFNRTYMANSTDMANSTETNSTRIITIRCRIKQIINMWQEVGRAMYAPPIAGNITCISNITGLLLTRDGGNNNTETFRPVGGNMKDNWRSKLYKYKVVEVKPLGVAPTKARRRMVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYDLLEESQNQQEKNEQDLLALDRWNSLWNWFNITKWLWYIKIFIMIVGGLIGLKIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLEGLVQYWGLELKRSAISLLDTLAIAVGEGTDRILEFVLGICRAIRNIPTRIRQGFETALL

SEQ ID NO: 375 - protein, 862 aa, Human immunodeficiency virus
MRVMGRQRNYPQWWIWSMLGLWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCTDANATASNTNATASNINATASKNSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPDKNITFQSSSGGDPEITTHSFNCGGEFFYCNTSSLFNRTYMANSTDMANSTETNSTRIITIRCRIKQIINMWQEVGRAMYAPPIAGNITCISNITGLLLTRDGGNSSTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTEMIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRKRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 376 - protein, 867 aa, Human immunodeficiency virus
MRVMGIQRNYPQWWIWSMLGLWMLMTCNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSKKLKEYFPDKNITFQSSSGGDPEITTHSFNCGGEFFYCNTSSLFNRTYMANSTDMANSTETNSTRIITIHCRIKQIINMWQEVGRAMYAPPIAGNITCISNITGLLLTRDGGENNGGKNNTETFRPGGGNMKDNWRSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGGLVQYWGLELKRSAISLLDTLAIAVGEGTDRILEFVLGICRAIRNIPTRIRQGFETALL

SEQ ID NO: 377 - protein, 854 aa, Human immunodeficiency virus
MRVMGIQRNYPQWWIWSMLGLWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCTDANATASNINATTSKSSIIEEMKNCSFNITTELRDKREKKYALFYKLDIVQLDGNSSQYRLINCNTSVITQAWPKVSFDPIPIHYCAPAGYAILKCNNKTFNGTGPCNNVSTVQCTHGIKPVVSTQLLLNGSLAEGEIIIRPKNITDNGKTIIVHLNESVKIECTRPSNNTRTSIRIGPGQAFYATGQVIGDIREAHCNISESKWNETLQRVSKKLKEYFPDKNITFQSSSGGDPEITTHSFNCGGEFFYCNTSSLFNRTDMANSTETNSTRIITIRCRIKQIINMWQEVGRAMYAPPIAGNITCISNITGLLLTRDGGENNGGKNNTETFRPGGGNMKDNWRSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGGLVQYWGLELKRSAISLLDTLAIAVGEGTDRILEFVLGICRAIRNIPTRIRQGFETALL

SEQ ID NO: 378 - protein, 855 aa, Human immunodeficiency virus
RVMGIQRNYPQWWIWSMLGFWMLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCTDANATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQAFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 379 - protein, 856 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCTDANATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQAFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 380 - protein, 863 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQAFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 381 - protein, 863 aa, Human immunodeficiency virus; identical to SEQ ID NO: 380

SEQ ID NO: 382 - protein, 863 aa, Human immunodeficiency virus; identical to SEQ ID NO: 380

SEQ ID NO: 383 - protein, 863 aa, Human immunodeficiency virus; identical to SEQ ID NO: 380

SEQ ID NO: 384 - protein, 863 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQAFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQGYSPLSLQTLIPSPRGPDRPGRIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 385 - protein, 863 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQAFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLESLVQYWGLELKRSAISLLDTLAIAVGEGTDRILEFVLGICRAIRNIPTRIRQGFETALL

SEQ ID NO: 386 - protein, 863 aa, Human immunodeficiency virus
MKVRGIQRNYPQWWIWSMLGLWMLMICNGMWVTVYYGVPVWKEAKTTLFCASDAKAYEKEVHNVWATHACVPTDPNPQEMVLENVTENFNMWKNDMADQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQAFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGGLVQYWGLELKRSAISLLDTLAIAVGEGTDRILEFVLGICRAIRNIPTRIRQGFETALL

SEQ ID NO: 387 - protein, 863 aa, Human immunodeficiency virus
MRVMGIQRNYPQWWIWSMLGLWMLMICNGMWVTVYYGVPVWKEAKTTLFCASDAKAYEKEAHNVWATHACVPTDPNPQEMVLKNVTENFNMWKNDMADQMHEDVISLWDQSLKPCVKLTPLCVTLNCTDANATASNANATASNTNATVSNSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSKKLKEYFPHKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGGLVQYWGLELKRSAISLLDTLAIAVGEGTDRILEFVLGICRAIRNIPTRIRQGFETALL

SEQ ID NO: 388 - protein, 863 aa, Human immunodeficiency virus
MRVMGIQRNYPQWWIWSMLGLWMLMICNGMWVTVYYGVPVWKEAKTTLFCASDAKAYEKEAHNVWATHACVPTDPNPQEMVLKNVTENFNMWKNDMVDQMHEDVISLWDQSLKPCVKLTPLCVTLNCTDANATASNANATASNTNATVSNSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSKKLKEYFPHKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPGGGNMKDNWRSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLQRGWEALKYLGGLVQYWGLELKKSAISLLDTLAIAVGEGTDRILEFVLGICRAIRNIPTRIRQGFETALL

SEQ ID NO: 389 - protein, 857 aa, Human immunodeficiency virus
MRVMGIQRNYPQWWIWSMLGLWMLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNRTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPDKNITFQSSSGGDPEITTHSFNCGGEFFYCNTSSLFNRTYMANSTETNSTRTITLHCRIKQIINMWQEVGRAMYAPPIAGNITCISNITGLLLTRDGGNDTDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKNQQLLGMWGCSGKLICTTNVYWNSSWSNKTYGDIWDNMTWMQWEREISNYTEIIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKRLRRGWKALKYLGGLVQYWGLELKRSAISLLDTLAIAVGEGTDRILEFVLGICRAIRNIPTRIRQGFETALL

SEQ ID NO: 390 - protein, 885 aa, Human immunodeficiency virus
MRVRGIQRSYPQWWIWSMLGFWMLMICNGMWVTVYYGVPVWKEAKTTLFCASDAKAYEKEVHNVWATHACVPTDPNPQEKVLKNVTDAKAYEKEVHNVWATHACVPTDPNPQEKVLKNVTENFNMWENDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREIGNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 391 - protein, 837 aa, Human immunodeficiency virus
MRVRGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSNSNILEGMKNCSFNITTELRDKREKKNALFYKLDIVQLGGSSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNMPTRIRQGFETALL

SEQ ID NO: 392 - protein, 851 aa, Human immunodeficiency virus
MRVMGIQRSYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLSCINATNATDSNNSILEGMKNCSFNITTELRDKREKKNALFYKLDIVQLYGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYSDIWDNMTWMQWEREISNYTDMIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLGQYWGLELKRSAISLLDTLAIAVGEGTDRILEFVLGICRAIRNIPTRIRQGFETALL

SEQ ID NO: 393 - protein, 851 aa, Human immunodeficiency virus
MRVRGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATASNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMANSTDMANSTETNSTRIITLHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYSDIWDNMTWMQWEREISNYTDMIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWNDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 394 - protein, 850 aa, Human immunodeficiency virus
RVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWTETLQRVSEKLKKYFPDKNITFRPSSGGDLEITTHSFNCGGEFFYCNTSSLFNRTYMATSTDMANSTEINSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 395 - protein, 851 aa, Human immunodeficiency virus
MRVRGIQRSYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 396 - protein, 851 aa, Human immunodeficiency virus
MRVRGIQRSYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSDNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFSYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 397 - protein, 851 aa, Human immunodeficiency virus
MRVRGIQRSYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGDMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLVGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 398 - protein, 851 aa, Human immunodeficiency virus; identical to SEQ ID NO: 395

SEQ ID NO: 399 - protein, 851 aa, Human immunodeficiency virus; identical to SEQ ID NO: 395

SEQ ID NO: 400 - protein, 851 aa, Human immunodeficiency virus; identical to SEQ ID NO: 395

SEQ ID NO: 401 - protein, 851 aa, Human immunodeficiency virus
MRVRGIQRSYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLGQYWGLELKRSAISLLDTLAIAVGEGTDRILEFVLGICRAIRNIPTRIRQGFETALL

SEQ ID NO: 402 - protein, 851 aa, Human immunodeficiency virus
MRVRGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 403 - protein, 851 aa, Human immunodeficiency virus
MRVRGIQRSYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 404 - protein, 851 aa, Human immunodeficiency virus; identical to SEQ ID NO: 403

SEQ ID NO: 405 - protein, 851 aa, Human immunodeficiency virus; identical to SEQ ID NO: 403

SEQ ID NO: 406 - protein, 851 aa, Human immunodeficiency virus
MRVRGIQRSYPQWWIWSMLGFWMLMICNGMWVTVYYGVPVWKEAKPTLFCASDAKAYEKEVHNVWATHACVPTDPNPQEMVLKNVTENFNMWENDMVDQMHEDVISLWDQSLKPCVKLTPLCVTLNCINATNATDSNSNILEGMKNCSFNITTELRDKREKKNALFYKLDIVQLGGNSSQYRLINCNTSVIAQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 407 - protein, 851 aa, Human immunodeficiency virus
MRVRGIQRSYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKAFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 408 - protein, 851 aa, Human immunodeficiency virus
MRVRGIQRSYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDKWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYRNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 409 - protein, 851 aa, Human immunodeficiency virus
MRVRGIQRSYPQWWIWSMLGFWMLMICNGMWVTVYYGVPVWREAKTTLFCASDAKAYEKEVHNVWATHACVPTDPNPQEMVLKNVTENFNMWENDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSKKLKKYFPDKNITFRPSSGGDLEITTHSFNCGGEFFYCNTSSLFNRTYMATSIDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNKVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 410 - protein, 852 aa, Human immunodeficiency virus
MRVRGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGNDTDTDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYSDIWDNMTWMQWEREISNYTEIIYDLLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 411 - protein, 852 aa, Human immunodeficiency virus
MRVMGTQRNYPQWWIWSMLGLWMLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCVTLYCINATANATVSNSSIIEEMKNCSFNITTELRDKREKKNALFYKLDIVQLDGNSSQYRLINCNTSAITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRQAHCNISESKWNETLQRVSEKLKEYFPNKTITFQPSSGGDPEITTHSFNCGGEFFYCNTSSLFNRTYMANSTDMANSTETNSTRTITLHCRIKQIINMWQEVGRAMYAPPIAGNITCISNITGLLLTRDGGNSSKETETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDLIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFLYHRLRDFILIAARAGELLGRSSLKGLRRGWEALKYLGGLVQYWGLELKRSAISLLDTLAIAVGEGTDRILEFVLGICRAIRNIPTRIRQGFETALL

SEQ ID NO: 412 - protein, 844 aa, Human immunodeficiency virus
MRVMGIQRNCPQWWIWSMLGLWMLMICNGMWVTVYYGVPVWKEAKTTLFCASDAKAYEKEVHNVWATHACVPTDPNPQEMVLKNVTENFNMWKNDMVNQMHEDVISLWDQSLKPCVKLTPLCVTLYCTNATANATVSNSSIIEEMKNCSFNITTELRDKREKKNALFYKLDIVQLDGNSSQYRLINCNTSAITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSEKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENDTETFRPVGGNMKDNWRSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTNIIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGGIVQYWGLELKRSAISLLDTLAIAVGEGTDRILEFVLGICRAIRNIPTRIRQGFETALL

SEQ ID NO: 413 - protein, 850 aa, Human immunodeficiency virus
MRVRGIQRNYPQWWIWSMLGLWMLMICNGMWVTVYYGVPVWKEAKTTLFCASDAKAHEKEVHNVWATHACVPTDPNPQEMVLKNVTENFNMWENDMVDQMHEDVISLWDQSLKPCVKLTPLCVTLYCTNATANATVSNSSIIEEMKNCSFNITTELRDKREKKYALFYKLDIVQLDGNSSGNSSQYRLINCNTSAITQACPKVSFDPIPIHYCAPAGYAILKCNNKTFNGTGPCNNVSTVQCTHGIKPVVSTQLLLNGSLAEGEIIIRSKNITDNGQTIIVHLNESVKIECTRPSNNTRTSIRIGPGQAFYATGQVIGDIRKAHCNISESKWNETLQRVSEKLKEYFPNKNITFQPSSGGDPEITTHSFNCGGEFFYCNTSSLFNRTYMANSTETNSTRTITLHCRIKQIINMWQEVGRAMYAPPIAGNITCISNITGLLLTRDGGNSSKETETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLRLTVWGIKQLQARVLALERYLKDQQLLGMWGCSGKLICTTNVYWNSSWSNKTYGDIWNNMTWMQWEREISNYTDMIYNLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRKRSTRLVSGFLALVWDDLRSLCLFLYHRLRDFILIAARAGELLGRSSLKGLRRGWEALKYLGSLVQYWGLELKGSAISLLDTLAIAVGEGTDRILEFVLGICRAIRNIPTRIRQGFETALL

SEQ ID NO: 414 - protein, 853 aa, Human immunodeficiency virus
MRVRGIQRNYPQWWIWSMLGLWMLMICNGMWVTVYYGVPVWKEAKTTLFCASDAKAYEKEMHNVWATHACVPTDPNPQEMVLKNVTENFNMWKNDMVDQMHEDVISLWDQSLKPCVKLTPLCVTLNCTDANDANATASNTNATVSNNSSIIEEMKNCSFNITTELRDKIEKKYALFYKLDIVQLDGNSSHYRFINCNTSAITQACPKVSFDPIPIHYCAPAGYAILKCNNKTFNGTGPCNNVSTVQCTHGIKPVVSTQLLLNGSLAEGEIIIRSKNITDNGNTIIVHLNESVKIECTRPSNNTRTSIRIGPGQAFYATGQVIGDIRQAHCNISESKWNETLQRVSEKLKEYFPNKTITFQPSSGGDPEITTHSFNCGGEFFYCNTSSLFNRTYMANSTETNSTRTITLHCRIKQIINMWQEVGRAMYAPPIAGNITCISNITGLLLTRDGGNTTDMETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTMQWEREISNYTEIIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGGLVQYWGLELKKSAISLLDTLAIAVGEGTDRILEFVLGICRAIRNIPTRIRQGFETALL

SEQ ID NO: 415 - protein, 857 aa, Human immunodeficiency virus
MRVRGIQRNYPQWWIWSMLGLWMLMICNGMWVTVYYGVPVWKEAKTTLFCASDAKAYEKEAHNVWATHACVPTDPNPQEMVLKNVTENFNMWENDMVDQMHEDVISLWDQSLKPCVKLTPLCVTLNCTDANATASNTNATVSNIKATVSNSSIIEEMKNCSFNITTELRDKIEKKYALFYKLDIVQLDGNSTQYRFINCNTSAITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPGNNTRTSIRIGPGQAFYATGQVIGDIRQAHCNISESKWNETLQRVSEKLKEYFPNKTITFQPSSGGDPEITTHSFNCGGEFFYCNTSSLFNRTYMANSTETNSTRTITLHCRIKQIINMWQEVGRAMYAPPIAGNITCISNITGLLLTRDGGNTTDIETFRPGGGNMKDNWRSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTEIIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGGIVQYWGLELKRSAISLLDTLAIAVGEGTDRILEFVLGICRAIRNIPTRIRQGFETALL

SEQ ID NO: 416 - protein, 859 aa, Human immunodeficiency virus
MRVRGIQRNYPQWWIWSMLGLWMLMICNGMWVTVYYGVPVWKEAKTTLFCASDAKAYEKEAHNVWATHACVPTDPNPQEMVLKNVTENFNMWENDMVDQMHEDVISLWDQSLKPCVKLTPLCVTLNCTDANATASNANATASNTNATVSNDSSIIEEMKNCSFNITTELRDKIEKKYALFYKLDIVQLDGNSTQYRFINCNTSAITQACPKVSFDPIPIHYCAPAGYAILKCNNKTFNGTGPCNNVSTVQCTHGIKPVVSTQLLLNGSLAEGEIIIRSKNITDNGNTIIVHLNESVKIECTRPSNNTRTSIRIGPGQAFYATGQVIGDIRQAHCNISESKWNETLQRVSEKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGNSSKETETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLRLTVWGIKQLQARVLALERYLKDQQLLGMWGCSGKLICTTNVYWNSSWSNKTYSDIWDNMTWMQWEGEISNYTEIIYNLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRKRSTRLVSGFLALVWDDLRSLCLFLYHRLRDFILIAARAGELLGRSSLKGLRRGWEALKYLGSLVQYWGLELKGSAISLLDTLAIAVGEGTDRILEFVLGICRAIRNIPTRIRQGFETALL

SEQ ID NO: 417 - protein, 857 aa, Human immunodeficiency virus
MRVMGRQRNYPQWWIWSMLGLWMLMICNGMWVTVYYGVPVWKEAKTTLFCASDAKAYEKEVHNVWATHACVPTDPNPQEMVLKNVTENFNMWKNDMVDQMHEDVISLWDQSLTPCVKLTPLCVTLTCTDANATASNATASNTNATASNSSIMIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIRIGPGQAFYATGQVIGDIRKAHCNISESKWSETLQRVSKKLKEYFPDKNITFQPSSGGDPEITTHSFNCGGEFFYCNTSSLFNRTDMANSTETNSTRIITLHCRIKQIINMWQEVGRAMYAPPIAGNITCISNITGLLLTRDGGNSSKETETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYSDIWDNMTWMQWEKEISNYTEMIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRKRSTRLVSGFLALVWDDLRSLCLFLYHRLRDFILIAARAGELLGRSSLKGLRRGWEALKYLGSLVQYWSLELKRSAISLLDTLAIAVGEGTDRILEFVLGICRAIRNIPTRIRQGFETALL

SEQ ID NO: 418 - protein, 858 aa, Human immunodeficiency virus
MRVMGRQRNYPQWWIWSMLGLWMLMICNGMWVTVYYGVPVWKEAKTTLFCASDAKAYEKEVHNVWATHACVPTDPNPQEMVLKNVTENFNMWKNDMVDQMHEDVISLWDQSLTPCVKLTPLCVTLNCTDANDTASNSSIIKGMNNSIVGEMKNCSFNITTELRDKREKKNALFYKLDIVQLDGNSSEYRLINCNTSVITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIRIGPGQAFYATGQVIGDIRKAHCNISESKWNETLQRVSKKLKEYFPDKNITFQPSSGGDPEITTHSFNCGGEFFYCNTSSLFNRTYMANSTDMANSAETNSTRTITLHCRIKQIINMWQEVGRAMYAPPIAGNITCISNITGLLLTRDGGNSSTETETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLRLTVWGIKQLQARVLALERYLKDQQLLGMWGCSGKLICTTNVYWNSSWSNKTYDDIWDNMTWMQWEGEISNYTNIIYDLLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRKRSTRLVSGFLALVWDDLRSLCLFLYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 419 - protein, 858 aa, Human immunodeficiency virus; identical to SEQ ID NO: 418

SEQ ID NO: 420 - protein, 858 aa, Human immunodeficiency virus
MRVMGRQRNYPQWWIWSMLGLWMLMICNGMWVTVYYGVPVWKEAKTTLFCASDAKAYEKEVHNVWATHACVPTDPNPQEMVLKNVTENFNMWKNDMVDQMHEDVISLWDQSLTPCVKLTPLCVTLNCTDANDTASNSSIIKGMNNSIVGEMKNCSFNITTELRDKREKKNALFYKLDIVQLDGNSSEYRLINCNTSVITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIRIGPGQAFYATGQVIGDIRKAHCNISESKWNETLQRVSKKLKEYFPDKNITFQPSSGGDPEITTHSFNCGGEFFYCNTSSLFNRTYMANSTDMANSAETNSTRTITLHCRIKQIINMWQEVGRAMYAPPIAGNITCISNITGLLLTRDGGNSSTETETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLRLTVWGIKQLQARVLALERYLKDQQLLGMWGCSGKLICTTNVYWNSSWSNKTYGDIWDNMTWMQWESEISNYTNIIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRKRSTRLVSGFLALVWDDLRSLCLFLYHRLRDFILIAARAGELLGRSSLKGLRRGWEALKYLGSLVQYWGLELKGSAISLLDTLAIAVGEGTDRILEFVLGICRAIRNIPTRIRQGFETALL

SEQ ID NO: 421 - protein, 858 aa, Human immunodeficiency virus
MRVMGRQRNYPQWWIWSMLGLWMLMICNGMWVTVYYGVPVWKEAKTTLFCASDAKAYEKEVHNVWATHACVPTDPNPQEMVLKNVTENFNMWKNDMVDQMHEDVISLWDQSLTPCVKLTPLCVTLNCTDANDTASNSSIIKGMNNSIVGEMKNCSFNITTELRDKREKKNALFYKLDIVQLDGNSSEYRLINCNTSVITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIRIGPGQAFYATGQVIGDIRKAHCNISESKWNETLQRVSKKLKEYFPDKNITFQPSSGGDPEITTHSFNCGGEFFYCNTSSLFNRTYMANSTDMANSAETNSTRTITLHCRIKQIINMWQEVGRAMYAPPIAGNITCISNITGLLLTRDGGNSSTETETFRPGGGNMKDNWRSELYKYKVVEVKPLGIAPTNARRRVVEREKRAVGMGAVFLGFLGAAGSTMGAASITLTVQARQLLSGIVQQQSNLLKAIEAQQHMLRLTVWGIKQLQARVLALERYLKDQQLLGMWGCSGKLICTTNVYWNSSWSNKTYGDIWDNMTWMQWESEISNYTNIIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRKRSTRLVSGFLALVWDDLRSLCLFLYHRLRDFILIAARAGELLGRSSLKGLRRGWEALKYLGSLVQYWGLELKGSAISLLDTLAIAVGEGTDRILEFVLGICRAIRNIPTRIRQGFETALL

SEQ ID NO: 422 - protein, 850 aa, Human immunodeficiency virus
MRVRGIQRNYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCINATNATDSKSNILEGMKNCSFNITTELRDKREKKNALFYKLDIVQLGGNSNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPQKNITFQPSSGGDLEITTHSFNCGGEFFYCNTSSLFNRTYMATGTDMANSTETNIITIHCRIKQIINMWQEVGRAMYAPPIAGNITCISNITGLLLTRDGGNSTEDTETFRPVGGNMKDNWSSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 423 - protein, 851 aa, Human immunodeficiency virus
MRVRGIQRNYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVRLTPLCVTLNCINATNATASDSSILDGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMATSTDMANSTETNSTQIITIHCRIKQIINMWQEVGRAMYAPPIAGNITCISNVTGLLLTRDGGNNTEDTETFRPVGGNMKDNWSSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTELIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 424 - protein, 848 aa, Human immunodeficiency virus
MRVRGIQRSYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNIITIHCRIKQIINMWQEVGRAMYAPPIAGNITCISNITGLLLTRDGGNNTEDTETFRPVGGNMKDNWSSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYSDIWDNMTWMQWEREISNYTDMIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 425 - protein, 851 aa, Human immunodeficiency virus
MRVRGIQRNYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCINATNATDSNSSILGGMKNCSFNITTELRDKREKKNALFYKLDIVQLGSNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFSRTYMANSTDMANSTETNSTQIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTDLIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 426 - protein, 851 aa, Human immunodeficiency virus
MRVRGIQRSYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCINATNATASDSSILDGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHFNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMANSTDMANSTETNSTQIITIHCRIKQIINMWQEVGRAMYAPPIAGNITCISNITGLLLTRDGGNNTEDTETFRPVGGNMKDNWSSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 427 - protein, 857 aa, Human immunodeficiency virus
MRVTGIQRNYPQWWIWSMLGLWMLMICNGMWVTVYYGVPVWKEAKTTLFCASDAKGYEKEVHNVWATHACVPTDPNPQEMVLKNVTENFNMWKNDMVDQMHEDVISLWDQSLKPCVKLTPLCVTLYCTNATANATASNINVTVSNSSIIEEMKNCSFNITTELRDKREKKYALFYKLDIIQLDGSSSQYRLINCNTSAITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIGIGPGQAFYATGQVIGDIRKAHCNISESKWNETLQRVSKKLKEYFPDKNITFQPSSGGDPEVTTHSFNCGGEFFYCNTSSLFNRTYMTNSTDMANSTETNRTITIHCRIKQIINMWQEVGRAMYAPPIAGNITCISNITGLLLTRDGGNSSTGTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYVDIWDNMTWMQWEREISNYTDIIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFLYHRLRDFILIAARAGELLGRSSLKGLRRGWEALKYLGGLVQYWGLELKRSAISLLDTLAIAVGEGTDRILEFVLGICRAIRNIPTRIRQGFETALL

SEQ ID NO: 428 - protein, 855 aa, Human immunodeficiency virus
MRVRGIQRSYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATASDSSILDGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMANSTDMANSTETNSTQIITIHCRIKQIINMWQEVGRAMYAPPIAGNITCISNITGLLLTRDGGNNTETSETVSEIFRPVGGNMKDNWSSELYKYKVVEVKPLGVAPTNARRRVVEREKRAVGMGAVFLGFLGAAGSTMGAASITLTVQARQLLSGIVQQQSNLLKAIEAHQHMLKLTVWGIKQLQARVLALERYLKDQQLLGMWGCSGKLICTTNVYWNSSWSNKTYDDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 429 - protein, 848 aa, Human immunodeficiency virus
MRVRGIQRNYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVRLTPLCVTLNCINATNATASDSSILDGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFQPSSGGDLEITTHSFNCGGEFFYCNTSSLFNRTYMATSTDLANSTETNIITIHCRIKQIINMWQEVGRAMYAPPIAGNITCISNITGLLLTRDGGNNTEDTETFRPVGGNMKDNWSSELYKYKVVEVKPLGVAPTNARRRVVKREKRAVGMGAMFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTELIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 430 - protein, 863 aa, Human immunodeficiency virus
MRVMGRQRNYPQWWIWSMLGLWMLMICNGMWVTVYYGVPVWKEAKTTLFCASDAKGYEKEVHNVWATHACVPTDPNPQEMVLKNVTENFNMWENDMVDQMHEDVISLWDQSLKPCVKLTPLCVTLNCTDANATASNANATVSNTNATVSNDSSIIEEMKNCSFNITTELRDKIEKKYALFYKLDIVQLDGNSTHYRFINCNTSAITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIGIGPGQAFYATGQVIGDIRKAHCNISESKWNETLQRVSKKLKEYFPGKNITFQPSSGGDPEVTTHSFNCGGEFFYCNTSSLFNRTYMTNSTDMANSTETNRTITIHCRIKQIINMWQEVGRAMYAPPIAGNITCISNITGLLLTRDGGNSSTETETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLRLTVWGIKQLQARVLALERYLKDQQLLGMWGCSGKLICTTNVYWNSSWSNKTYDDIWDNMTWMQWEGEISNYTNIIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRKRSTRLVSGFLALVWDDLRSLCLFLYHRLRDFILIAARAGELLGRSSLKGLRRGWEALKYLGSLVQYWGLELKGSAISLLDTLAIAVGEGTDRILEFVLGICRAIRNIPTRIRQGFETALL

SEQ ID NO: 431 - protein, 851 aa, Human immunodeficiency virus
MRVRGIQRSYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSKSNILEGMKNCSFNITTELRDKREKKNALFYKLDIVQLGSNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMANSTDMANSTETNSTQIITIHCRIKQIINMWQEVGRAMYAPPIAGNITCISNITGLLLTRDGGNNTEDTETFRPVGGNMKDNWSSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 432 - protein, 851 aa, Human immunodeficiency virus
MRVRGIQRSYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCINATNATASDSSILDGMKNCSFNITTELRDKREKKNALFYKLDIVQLGSNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKKITFQPSSGGDLEITTHSFNCGGEFFYCNTSSLFNRTYMANSTDMANSTETNSTQIITIHCRIKQIINMWQEVGRAMYAPPIAGNITCISNITGLLLTRDGGNNTEDTETFRPVGGNMKDNWSSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 433 - protein, 862 aa, Human immunodeficiency virus
MRVMGRQRNYPQWWIWSMLGLWMLMICNGMWVTVYYGVPVWKEAKTTLFCASDAKGYEKEVHNVWATHACVPTDPNPQEMVLKNVTENFNMWENDMVDQMHEDVISLWDQSLKPCVKLTPLCVTLNCTDANATASNANATVSNTNATVSNDSSIIEEMKNCSFNITTELRDKIEKKYALFYKLDIVQLDGNSTHYRFINCNTSAITQACPKVSFDPIPIHYCAPAGYAILKCNNKTFNGTGPCNNVTTVQCTHGIKPVVSTQLLLNGSLAEGEIIIRSKNITDNGNTIIVHLNESVKIECTRPGNNTRTSIRIGPGQAFYATGQVIGDIRQAHCNISESKWNETLQRVSEKLKEYFPNKTITFQPSSGGDPEVTTHSFNCGGEFFYCNTSSLFNRTYMTNSTDMANSTETNRTITIHCRIKQIINMWQEVGRAMYAPPIAGNITCISNITGLLLTRDGGNNTDPEIFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLRLTVWGIKQLQARVLALERYLKDQQLLGMWGCSGKLICTTNVYWNSSWSNKTYGDIWDNMTWMQWESEISNYTNIIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRKRSTRLVSGFLALVWDDLRSLCLFLYHRLRDFTLIAARAGELLGRSSLKGLRRGWEALKYLGSLVQYWGLELKGSAISLLDTLAIAVGEGTDRILEFVLGICRAIRNIPTRIRQGFETALL

SEQ ID NO: 434 - protein, 851 aa, Human immunodeficiency virus
MRVRGIQRSYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATDSKSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMANSTDMANSTETNSTQIITIHCRIKQIINMWQEVGRAMYAPPIAGNITCISNITGLLLTRDGGNNTEDTETFRPVGGNMKDNWSSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 435 - protein, 848 aa, Human immunodeficiency virus
MRVRGIQRNYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVRLTPLCVTLNCINATNATASDSSILDGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFQPSSGGDLEITTHSFNCGGEFFYCNTSSLFNRTYMATSTDMANSTETNIITIHCRIKQIINMWQEVGRAMYAPPIAGNITCISNITGLLLTRDGGNNTEDTETFRPVGGNMKDNWSSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYSDIWDNMTWMQWEREISNYTDMIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKKSAISLLDTLAIAVGEGTDRILEFVLGICRAIRNIPTRIRQGFETALL

SEQ ID NO: 436 - protein, 851 aa, Human immunodeficiency virus
MRVRGIQRSYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCINATNATASDSSILDGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSKKLKEYFPDKNITFQPSSGGDLEITTHSFNCGGEFFYCNTSSLFNRTYMATSTDMANSTETNSTQIITIHCRIKQIINMWQEVGRAMYAPPIAGNITCISNITGLLLTRDGGNNTEGTETFRPVGGNMKDNWSSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYSDIWDNMTWMQWEREISNYTDMIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 437 - protein, 850 aa, Human immunodeficiency virus
MRVRGIQRSYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVRLTPLCVTLNCINATNATASDSSILDGMKNCSFNITTELRDKREKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVVGNIREAHCNISESKWNETLQRVSEKLKEYFPDKNITFQPSSGGDLEITTHSFNCGGEFFYCNTSSLFNRTYMANSTDMANSTETNSTQIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKGSAISLLDTLAIAVGEGTDRILEFVLGICRAIRNIPTRIRQGFETALL

SEQ ID NO: 438 - protein, 851 aa, Human immunodeficiency virus
MRVRGIQRSYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCINATNATASDSSILDGMKNCSFNITTELRDKREKKNALFYKLDIVQLGSNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMANSTDMANSTETNSTQIITIHCRIKQIINMWQEVGRAMYAPPIAGNITCISNITGLLLTRDGGNNTEDTETFRPVGGNMKDNWSSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 439 - protein, 848 aa, Human immunodeficiency virus
MRVRGIQRSYPQWWIWSMLGLWMLMICNGMWVTVYYGVPVWKEAKTTLFCASDAKAYEKEVHNVWATHACVPTDPNPQEMVLKNVTENFNMWENDMVDQMHEDVISLWDQSLKPCVRLTPLCVTLNCINATNATASDSSILDGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFQPSSGGDLEITTHSFNCGGEFFYCNTSSLFNRTYMATSTDMANSTETNIITIHCRIKQIINMWQEVGRAMYAPPIAGNITCISNITGLLLTRDGGNNTEDTETFRPVGGNMKDNWSSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYSDIWDNMTWMQWEREISNYTDMIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 440 - protein, 848 aa, Human immunodeficiency virus
MRVRGIQRSYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVRLTPLCVTLNCINATNATASDSSILDGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFQPSSGGDLEITTHSFNCGGEFFYCNTSSLFNRTYMATSTDMANSTETNIITIHCRIKQIINMWQEVGRAMYAPPIAGNITCISNITGLLLTRDGGNNTEDTETFRPVGGNMKDNWSSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTEIIYDLLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 441 - protein, 851 aa, Human immunodeficiency virus; identical to SEQ ID NO: 438

SEQ ID NO: 442 - protein, 851 aa, Human immunodeficiency virus
MRVKGIQRNYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCINATNTTDSNSNILEGMKNCSFNITTELRDKREKKNALFYKLDIVQLGGNSSGNSSQYRLINCNTSVITQACPKVSFDPIPIHYCAPAGYAILKCNNKTFNGTGPCNNVSTVQCTHGIKPVVSTQLLLNGSLAEGKIIIRSKNITDNSKTIIVHLNESVKIECTRPSNNTRTSIRIGPGQAFYATGQVIGNIREAHCNISESKWNETLQRVSEKLKKYFPDKNITFQPSSGGDLEITTHSFNCGGEFFYCNTSSLFNRTYMATSTDMANSTETNIITIHCRIKQIINMWQEVGRAMYAPPIAGNITCISNITGLLLTRDGGNNTEDTETFRPVGGNMKDNWSSELYKYKVVEVKPLGVAPTNARRRVVEREKRAVGMGAVFLGFLGAAGSTMGAASITLTVQARQLLSGIVQQQSNLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGKGTDRILEFVLGICRAIRNIPTRIRQGFETALL

SEQ ID NO: 443 - protein, 851 aa, Human immunodeficiency virus
MRVRGIQRSYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCINATNATASDSSILDGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKEYFPDKNITFQPSSGGDLEITTHSFNCGGEFFYCNTSSLFNRTYMANSTDMANSTETNSTQIITIHCRIKQIINMWQEVGRAMYAPPIAGNITCISNITGLLLTRDGGNNTEDTETFRPVGGNMKDNWSSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYSDIWDNMTWMQWEREISNYTDMIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 444 - protein, 848 aa, Human immunodeficiency virus
MRVRGIQRSYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCINATNATASDSSILDGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNIITIHCRIKQIINMWQEVGRAMYAPPIAGNITCISNITGLLLTRDGGNNTEDTETFRPVGGNMKDNWSSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTELIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 445 - protein, 862 aa, Human immunodeficiency virus
MRVMGRQRNYPQWWIWSTLGLRMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCTDANATASNANATVSNTNATVSNDSSIIEEMKNCSFNITTELRDKIEKKYALFYKLDIVQLDGNSTHYRFINCNTSAITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIGIGPGQAFYATGQVIGDIRKAHCNISESKWNETLQRVSKKLKEYFPGKNITFQPSSGGDPEVTTHSFNCGGEFFYCNTSSLFNRTYMTNSTDMANSTETNRTITIHCRIKQIINMWQEVGRAMYAPPIAGNITCISNITGLLLTRDGGNNTDPEIFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLRLTVWGIKQLQARVLALERYLKDQQLLGMWGCSGKLICTTNVYWNSSWSNKTYGDIWDNMTWMQWESEISNYTNIIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRKRSTRLVSGFLALVWDDLRSLCLFLYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 446 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 447 - DNA, 2523 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaaccactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 448 - DNA, 2523 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 449 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacgcatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctggggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 450 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcttaccagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 451 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggataagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 452 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgtcactctaaactgtaccaatgctactgccagcaatagcagtataatagaaggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 453 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 454 - DNA, 2541 bp, Human immunodeficiency virus; identical to SEQ ID NO: 453

SEQ ID NO: 455 - DNA, 2541 bp, Human immunodeficiency virus; identical to SEQ ID NO: 453

SEQ ID NO: 456 - DNA, 2541 bp, Human immunodeficiency virus; identical to SEQ ID NO: 446

SEQ ID NO: 457 - DNA, 2541 bp, Human immunodeficiency virus; identical to SEQ ID NO: 446

SEQ ID NO: 458 - DNA, 2541 bp, Human immunodeficiency virus; identical to SEQ ID NO: 446

SEQ ID NO: 459 - DNA, 2541 bp, Human immunodeficiency virus; identical to SEQ ID NO: 446

SEQ ID NO: 460 - DNA, 2541 bp, Human immunodeficiency virus; identical to SEQ ID NO: 446

SEQ ID NO: 461 - DNA, 2541 bp, Human immunodeficiency virus; identical to SEQ ID NO: 446

SEQ ID NO: 462 - DNA, 2541 bp, Human immunodeficiency virus; identical to SEQ ID NO: 446

SEQ ID NO: 463 - DNA, 2541 bp, Human immunodeficiency virus; identical to SEQ ID NO: 446

SEQ ID NO: 464 - DNA, 2541 bp, Human immunodeficiency virus; identical to SEQ ID NO: 446

SEQ ID NO: 465 - DNA, 2541 bp, Human immunodeficiency virus; identical to SEQ ID NO: 446

SEQ ID NO: 466 - DNA, 2541 bp, Human immunodeficiency virus; identical to SEQ ID NO: 446

SEQ ID NO: 467 - DNA, 2541 bp, Human immunodeficiency virus; identical to SEQ ID NO: 446

SEQ ID NO: 468 - DNA, 2541 bp, Human immunodeficiency virus; identical to SEQ ID NO: 446

SEQ ID NO: 469 - DNA, 2541 bp, Human immunodeficiency virus; identical to SEQ ID NO: 446

SEQ ID NO: 470 - DNA, 2541 bp, Human immunodeficiency virus; identical to SEQ ID NO: 446

SEQ ID NO: 471 - DNA, 2541 bp, Human immunodeficiency virus; identical to SEQ ID NO: 446

SEQ ID NO: 472 - DNA, 2541 bp, Human immunodeficiency virus; identical to SEQ ID NO: 446

SEQ ID NO: 473 - DNA, 2541 bp, Human immunodeficiency virus; identical to SEQ ID NO: 446

SEQ ID NO: 474 - DNA, 2541 bp, Human immunodeficiency virus; identical to SEQ ID NO: 446

SEQ ID NO: 475 - DNA, 2541 bp, Human immunodeficiency virus; identical to SEQ ID NO: 446

SEQ ID NO: 476 - DNA, 2541 bp, Human immunodeficiency virus; identical to SEQ ID NO: 446

SEQ ID NO: 477 - DNA, 2541 bp, Human immunodeficiency virus; identical to SEQ ID NO: 446

SEQ ID NO: 478 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgttgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 479 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgagacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 480 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaaacaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 481 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataagaattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 482 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccaaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 483 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtgcacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 484 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagggaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 485 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctagaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 486 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacacatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 487 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattagaaatttgtagagctatccgcaacatacctacaagaataagacagggctttgaaacagctttgctataa

SEQ ID NO: 488 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgtaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 489 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggggagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 490 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataagcttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 491 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattctatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 492 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagatagaattctagaatttgtattaggaatttgtagagctatccgcaacatacctacaagaataagacagggctttgaaacagctttgctataa

SEQ ID NO: 493 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 494 - DNA, 2541 bp, Human immunodeficiency virus; identical to SEQ ID NO: 493

SEQ ID NO: 495 - DNA, 2541 bp, Human immunodeficiency virus; identical to SEQ ID NO: 493

SEQ ID NO: 496 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcacaatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 497 - DNA, 2537 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggtgtaataatgtcagcacagtacaatgtacacatggaattaagccagtgatttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtaccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 498 - DNA, 2523 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 499 - DNA, 2520 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 500 - DNA, 2542 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataggagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 501 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcactaacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 502 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtatacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagaacgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 503 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtatacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 504 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtgcacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 505 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataggagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 506 - DNA, 2541 bp, Human immunodeficiency virus; identical to SEQ ID NO: 504

SEQ ID NO: 507 - DNA, 2540 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaatgtcaaaacaataatagtacatctcaatgaatctgtaaagattgagtgtatgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtgcacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 508 - DNA, 2541 bp, Human immunodeficiency virus; identical to SEQ ID NO: 504

SEQ ID NO: 509 - DNA, 2541 bp, Human immunodeficiency virus; identical to SEQ ID NO: 503

SEQ ID NO: 510 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacaaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 511 - DNA, 2541 bp, Human immunodeficiency virus; identical to SEQ ID NO: 503

SEQ ID NO: 512 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttgaaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 513 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcgtcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtgatttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttagtaggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 514 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaagatctcttttgacccaattcctatacattattgtgctccagctggttatgcgattctaaagtgtaataatcagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacaatacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 515 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtgatttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 516 - DNA, 2540 bp, Human immunodeficiency virus
atgagagtgatggggatacagaggaattatccacaatggtggatatggagcatgttaggcttttggatgctaatgattgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtatggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 517 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagaataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcataatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggatgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 518 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattataacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaagcataacatgtatatcaaatatcacaggactactattgacaagggatggaggaaaaaacaatatggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 519 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataggagagagaaaaagaatgcacttttttataaacttgatatagtacaactagatggcaactctaatcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatacatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatgtcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 520 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggtaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtatacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 521 - DNA, 2541 bp, Human immunodeficiency virus; identical to SEQ ID NO: 503

SEQ ID NO: 522 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataggagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacatatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 523 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatatgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 524 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataggagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatacgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 525 - DNA, 2220 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatactaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttctttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 526 - DNA, 2220 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 527 - DNA, 2541 bp, Human immunodeficiency virus
atgagagtgatggggatacagaggaattatccacaatggtggatatggagcatgttaggcttttggatgctaatgatttgtaatgggatgtgggtcacagtytactatggggtacctgtgtggaaagaagcaaaaamtactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtatacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 528 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaamaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtayacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 529 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaamaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 530 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 531 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaggtgtaataataagacattcactggaacaggaccgtgtaataatgtcagcacagtacaatgtacacatggaattaagccagtggtttcaactcaactattgttaaatggtagcctagcagaaggagagataataattagatccgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagaactatccgcaacatacctacaagaataagacagggctttgaaacagctttgctataa

SEQ ID NO: 532 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttctactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatctactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaaacaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 533 - DNA, 2541 bp, Human immunodeficiency virus; identical to SEQ ID NO: 503

SEQ ID NO: 534 - DNA, 2541 bp, Human immunodeficiency virus; identical to SEQ ID NO: 493

SEQ ID NO: 535 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacaaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctcaggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaaccccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 536 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagaataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 537 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtgcacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 538 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacagcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagcctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaacagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 539 - DNA, 2541 bp, Human immunodeficiency virus; identical to SEQ ID NO: 503

SEQ ID NO: 540 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtatacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaacaatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 541 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtatacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaagggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 542 - DNA, 2541 bp, Human immunodeficiency virus; identical to SEQ ID NO: 446

SEQ ID NO: 543 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtgatttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaagaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 544 - DNA, 2541 bp, Human immunodeficiency virus; identical to SEQ ID NO: 537

SEQ ID NO: 545 - DNA, 2541 bp, Human immunodeficiency virus; identical to SEQ ID NO: 503

SEQ ID NO: 546 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtatacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacctacctacaagaataagacagggctttgaaacagctttgctataa

SEQ ID NO: 547 - DNA, 2541 bp, Human immunodeficiency virus; identical to SEQ ID NO: 503

SEQ ID NO: 548 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtaaacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 549 - DNA, 2522 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcgcttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 550 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtatacgaaccatcacaatccactgcagaataaaacaaattataaacatgtggcaggaggtgggacgagcaatgtatgtccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattagaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 551 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataggagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacargtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 552 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtatacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattyagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagatagrattctagaatttgtattaggaatttgtagagctatccgcaacatacctacaagaataagacagggctttgaaacagctttgctataa

SEQ ID NO: 553 - DNA, 2637 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctgagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgtcactctaaactgtaccaatgctactgccagcagtagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatccccaggaggggacctagaaattacaacacatagctttaattgtggaggagaatttttctattgcaatacatcaagcctgtttaataggacatatatggctaatagtacagatatggctaatagtacagaaactaacaatacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaacgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 554 - DNA, 2541 bp, Human immunodeficiency virus; identical to SEQ ID NO: 503

SEQ ID NO: 555 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggccaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 556 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatatgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacaatacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgagggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataataatagtaggaggcttgataggtttaagaataatttttgctgtgctttctttagtaaataaagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 557 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaggagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatatggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacaggctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 558 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 559 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgttactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacaaaccatcacaatccactgcagaataaaacaaattataaacatgtggcaggaggtgggacgagcaatgtatgcccctcccattgcaggaaacataacatgtatatcaaatatcacaagactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 560 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatatgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacaatacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 561 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatatgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 562 - DNA, 2541 bp, Human immunodeficiency virus; identical to SEQ ID NO: 503

SEQ ID NO: 563 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtatacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgaacggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 564 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgcggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtatacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttaggagcggcaggaagcactatgggcgcagcatcaataacgctgacggtacaggccagacaattattgtccggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 565 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtgatttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtatacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 566 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactaatattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 567 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacaatacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtattccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 568 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatgtggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 569 - DNA, 2541 bp, Human immunodeficiency virus
atgggagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacaaaccatcacaatccactgcagaataaaacaaattataaacatgtggcaggaggtgggacgagcaatgtatgcccctcccattgcagggaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagtggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 570 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgttaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtatacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgttataa

SEQ ID NO: 571 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagcaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 572 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcactaacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 573 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaatgagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtatacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 574 - DNA, 2541 bp, Human immunodeficiency virus; identical to SEQ ID NO: 503

SEQ ID NO: 575 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagtcgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 576 - DNA, 2202 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagaaactaacaatacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 577 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtryacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 578 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtryacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 579 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacgaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtgcacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtagtaggaatttgtagagctatccgcaacatacctacaagaataagacagggctttgaaacagctttgctataa

SEQ ID NO: 580 - DNA, 1883 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgtcactctaaactgtaccaatgctactaccagcaatagcagtataatagagggaatgaaaaattgctctttcaatataaccacagaattaagagataagagagagaaaaagaatgcacttttttataaacttgatatagtacaactagatggcaactctagtcacaaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 581 - DNA, 2541 bp, Human immunodeficiency virus; identical to SEQ ID NO: 505

SEQ ID NO: 582 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacaatacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 583 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacaatacacgaaccatcacaatccactgcagaataagacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtgggattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaagaacagataggattctagaatttgtattaggaatttgtagagctatccgcaacatacctacaagaataagacagggctttgaaacagctttgctataa

SEQ ID NO: 584 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatcaactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcactaacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 585 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccgtcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 586 - DNA, 2541 bp, Human immunodeficiency virus; identical to SEQ ID NO: 558

SEQ ID NO: 587 - DNA, 2541 bp, Human immunodeficiency virus; identical to SEQ ID NO: 537

SEQ ID NO: 588 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtaaacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcagcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgcttgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 589 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagctgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggaggagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 590 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacaatacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 591 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttataggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 592 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatactaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaaggaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 593 - DNA, 2541 bp, Human immunodeficiency virus; identical to SEQ ID NO: 558

SEQ ID NO: 594 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatcaactgcagaataaaacaaattataaacatgtggcaggaggtgggacgagcaatgtatgcccctcccattgcaggaaacataacatgtatatcaaatatcacaggactaatattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 595 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaagatctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgaaaagtcttgtgcagtattggggcctagaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 596 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataggagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaaaaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaacttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 597 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggctttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacattccaaccatcctcaggaggggacctagaaattacaacacatagctttaattgtggaggagaatttttctattgcaatacatcaagcctgtttaataggacatatatggctaatagtacagatatggctaatagtacagaaactaacagtatacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataagaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 598 - DNA, 2541 bp, Human immunodeficiency virus
atgagagtgatggggatacagaggaattatccacaatggtggatatggagcatgttaggcttttggatgctgatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagtaattatacagaaataatatatgaattgcttgaagaatcacaaaaccagcaggaaaagaatgaacaagatttactagcattggacagatggaacaggctgtggaattggtttaacataacaaattggctatggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 599 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacaggctgtggaatgggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 600 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacagctagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaacgaacagtacacgaaccatcaaaatccactgcagaataaaacaaattataaacatgtggcaggaggtgggacgagcaatgtatgcccctcccattgcaggaaacataacatgtatatcaaatatcacaggactactattgacaagagatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcagtaacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcaataggtgaaggaacagataggattctagaatttgtattaggaatttgtagagctatccgcaacatacctacaagaataagacagggctttgaaacagctttgctataa

SEQ ID NO: 601 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgtgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcaaaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctaaaatttgtattaggaatttgtagagctatccgaaacatacctacaagaataagacagggctttgaaacagctttgctataa

SEQ ID NO: 602 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagacgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattattaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcaaaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggaaagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctaaaatttgtattaggaatttgtagagctatccgcaacatacctacaagaataagacagggctttgaaacagctttgctataa

SEQ ID NO: 603 - DNA, 2541 bp, Human immunodeficiency virus; identical to SEQ ID NO: 602

SEQ ID NO: 604 - DNA, 2540 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcaaaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctaaaatttgtattaggaatttgtagagctatccgcaacatacctacaagaataagacagggctttgaaacagctttgctataa

SEQ ID NO: 605 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcaaaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctaaaatttgtattaggaatttgtagagctatccgcaacatacctacaagaataagacagggctttgaaacagctttgctataa

SEQ ID NO: 606 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcaaaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 607 - DNA, 2541 bp, Human immunodeficiency virus; identical to SEQ ID NO: 606

SEQ ID NO: 608 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcaaaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaagcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 609 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcaaaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggataattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 610 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgactccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcaaaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagaaagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 611 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcaaaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagagactacggagaggatgggaagcccttaagtatctgggaaatcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 612 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagaggaaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccgtcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 613 - DNA, 2542 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatactaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagaccccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 614 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgccgtgctttcgttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 615 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagaccyaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccrctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctaaaatttgtattaagaatttgtagagctatccgcaacatacctacaagaataagacagggctttgaaacagctttgctataa

SEQ ID NO: 616 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaaaagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagacggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 617 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagagatggttttaaaaaatgtaacagaaaatttcaacatgtggaaaaatgacatggtggatcagatgcatgaagatgtaattagtttatgggatcaaagcctcaagccatgtgtaaagttgaccccactctgtatcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctatcggataccctagcaatagcagtaggtgaaggaacagataggattctagaatttgtattaggaatttgtagagctatccgcaacatacctacaagaataagacagggctttgaaacagctttgctataa

SEQ ID NO: 618 - DNA, 2541 bp, Human immunodeficiency virus; identical to SEQ ID NO: 617

SEQ ID NO: 619 - DNA, 2541 bp, Human immunodeficiency virus; identical to SEQ ID NO: 617

SEQ ID NO: 620 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagcagcatattgtaacattaatgaaagtaaatggaatgaaactttacaaagggtaagtaaaaaattaaaagaatacttccctcataagaatataacatttcaaccatccccaggaggggacctagaaattacaacacatagctttaattgtggaggagaatttttctattgcaatacatcaagcctgtttaataggacatatatggctaatagtacagatatggctaatagtacagaaactaacaatacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatgcggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 621 - DNA, 2534 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagcagcatattgtaacattaatgaaagtaaatggaatgaaactttacaaagggtaagtaaaaaattaaaagaatacttccctcataagaatataacatttcaaccatccccaggaggggacctagaaattacaacacatagctttaattgtggaggagaatttttctattgcaatacatcaagcctgtttaataggacatatatggctaatagtacagatatggctaatagtacagaaactaacaatacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatgcggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagcttt

SEQ ID NO: 622 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactaccctattttgtgcatcagatgctaaagcatatgagaaagaagtgcataatgtctgggctacacatgcctgtgtacccacagaccccaatccacaagaaatgtttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagagaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagagcaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagcctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 623 - DNA, 2220 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctataaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaacagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 624 - DNA, 2220 bp, Human immunodeficiency virus; identical to SEQ ID NO: 623

SEQ ID NO: 625 - DNA, 2220 bp, Human immunodeficiency virus
atgagagtgatggggatacagaggaattatccacaatggtggatatggaacatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccaacaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaagtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacgacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 626 - DNA, 2221 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgcctgcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaattttttctattgcaatacatcaagcctgtttaataggacatatatggctaatagtacagatatggctaatagtacagaaactaacaatacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 627 - DNA, 2523 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccaacaatagcaatataatagaggaaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacagatatggctaatagtacagaaactaacaatacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacrggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 628 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccctaatccacaagaaatggttttaaaaaatgtaacagaaaatttcaacatgtggaaaaatgacatggtggatcagatgcatgaagatgtaattagtttatgggaccaaagcctcaagccatgtgtaaagttgaccccactctgtgtcactctaaactgtaccaatgctactgccagcaatagcaatataatagaggaaatgaaaaattgctctttcaatataaccacagaattaagagataagagagagaaaaagaatgcacttttttataaacttgatatagtacagctagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcaaaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagaaaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctaaaatttgtattaggaatttgtagagctatccgcaacatacctacaagaataagacagggctttgaaacagctttgctataa

SEQ ID NO: 629 - DNA, 2541 bp, Human immunodeficiency virus
atgagagtgatggggatacagaggaattatccacaatggtggatatggagcatgttaggcttttggatgctaatgatatgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagttttaattgtggaggagaatttttctattgcaatacatcaagcctgtttaataggacatatatggctaatagcacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagcagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaggtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 630 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggattaaagcctcaagccatgtgtaaagttgaccccactctgtgtcactctaaactgtaccaatgctactgccaacaatagcagtataatagagggaatgaaaaattgctctttcaatataaccacagaattaagagataagagagagaaaaagaatgtacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatactgagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagtagtaggtgaaggaacagataggattctagaatttgtattaggaatttgtagagctatccgcaacatacctacaagaataagacagggctttgaaacagctttgctataa

SEQ ID NO: 631 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctaatgccagcaataacagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcacattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 632 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatatcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagatataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaatcatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 633 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccaacaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggaaacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaagaatttgtagagctatccgcaacatacctacaagaataagacagggctttgaaacagctttgctataa

SEQ ID NO: 634 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccaacaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggaaacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacaggctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggagaaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaggtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 635 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtacataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccaacaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggaaacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 636 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccaacaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagaaaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 637 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaataacagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagaaaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacactccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 638 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacaatacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 639 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaacgaacagtacacgaaccatcaaaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 640 - DNA, 2541 bp, Human immunodeficiency virus
atgagagtgatggggatacaaaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgttagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataagaaacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcaaaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctagccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 641 - DNA, 2541 bp, Human immunodeficiency virus
atgagagtgatggggatacaaaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgttagcacagtacaatgtacacatggaattaagccagtggtttcaactcaactattgttaaatggtagcctagcagaaggagagataataattagatctgaaaatataacaaacaatgtcaaaacaataatagtacatctcaatgaatctgtaaagattgagtgtacgagacccaataataaaacaagaacaagtataagaataggaccaggacaagcattttatgcaacaggacaagtaataggaaacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcaaaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctagccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacaaatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 642 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagaaaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacaatacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcggggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaaatatctgggaagtcttgtgcagtattggggcctggaattaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 643 - DNA, 2541 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactaccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagaaaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttggattcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 644 - DNA, 2538 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagaaaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacaatacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggaaagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 645 - DNA, 2538 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacacgcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatgccaaaacaataatagtacatctcaatgaatctgtaaagattgagtgtacgagacccaataataaaacaagaacaagtataagaataggaccaggacaagcattttatgcaacaggacaagtaataggagacataagaaaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacaatacacgaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataagacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgcctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 646 - DNA, 2536 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaaatgtaacagaagatttcaacatgtggaaaaatgacatggtggatcagatgcatgaagatgtaattagtttatgggatcaaagcctcaagccatgtgtaaagttgaccccactctgtgtcactctaaactgtaccaatgctaatgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttcaactcaactattgttaaatggtagcctagcagaaggagagataataattagatctgaaaatataacaaacaatggcaaaacaataatagtacatctcaatgaatctgtaaagattgagtgtacgagacccaataataaaacaagaacaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagaaccatcacaatccactgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcgcaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttgcagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcacattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 647 - DNA, 2556 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttctactcaactattgttaaatggtagcctagcagaaggagagataataattagatctgaaaatataacaaacaatgtcaaaacaataatagtacatctcaatgaatctgtaaagattgagtgtacgagacccaataataaaacaagaaaaagtataagaataggaccaggacaagcattttatgcaacaggacaagtaataggagacataagagaagcatattgtaacattagtgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

SEQ ID NO: 648 - DNA, 2556 bp, Human immunodeficiency virus
atgagagtgatggggatacagaggaattatccacaatggtggatatggagcatgttaggcttttggatgctaatgatttgtaatgggatgtgggtcacagtctactatggggtacctgtgtggaaagaagcaaaaactactctattttgtgcatcagatgctaaagcatatgagaaagaagtgcataatgtctgggctacacatgcctgtgtacccacagaccccaatccacaagaaatggttttaaaaaatgtaacagaaaatttcaacatgtggaaaaatgacatggtggatcagatgcatgaagatgtaattagtttatgggatcaaagcctcaagccatgtgtaaagttgaccccactctgtgtcactctaaactgtaccaatgctactgccagcaatgctactgccagcaatagcagtataatagagggaatgaaaaattgctctttcaatataaccacagaattaagagataagagagagaaaaagaatgcacttttttataaacttgatatagtacaactagatggcaactctagtcagtatagattaataaattgtaatacctcagtcataacacaagcctgtccaaaggtctcttttgacccaattcctatacattattgtgctccagctggttatgcgattctaaagtgtaataataagacattcactggaacaggaccgtgtaataatgtcagcacagtacaatgtacacatggaattaagccagtggtttctactcaactattgttaaatggtagcctagcagaaggagagataataattagatctgaaaatataacaaacaatgtcaaaacaataatagtacatctcaatgaatctgtaaagattgagtgtacgagacccaataataaaacaagaaaaagtataagaataggaccaggacaagcattttatgcaacaggacaagtaataggagacataagagaagcatattgtaacattaatgaaagtaaatggaatgaaactttacaaagggtaagtaaaaaattaaaagaatacttccctcataagaatataacatttcaaccatcctcaggaggggacctagaaattacaacacatagctttaattgtggaggagaatttttctattgcaatacatcaagcctgtttaataggacatatatggctaatagtacagatatggctaatagtacagaaactaacagtacacgaaccatcacaatccgctgcagaataaaacaaattataaacatgtggcaggaggtgggacgagcaatgtatgcccctcccattgcaggaaacataacatgtatatcaaatatcacaggactactattgacaagggatggaggaaaaaacaatacggagacattcagacctggaggaggaaatatgaaggacaattggagaagtgaattatataaatataaagtggtagaagttaagccattaggagtagcacccactaatgcaagaaggagagtggtggagagagaaaaaagagcagtgggaatgggagctgtgttccttgggttcttgggagcggcaggaagcactatgggcgcagcatcaataacgctgacggtacaggccagacaattattgtctggtatagtgcaacagcaaagcaatttgctgaaggctatagaggctcaacagcatatgttgaaactcacggtctggggcattaaacagctccaggcaagagtcctggccttggaaagatacctaaaggatcaacagctcctagggatgtggggctgctctggaaaactcatctgcaccactaatgtatattggaactctagttggagtaataaaacttatggtgatatttgggataacatgacctggatgcagtgggagagagaaattagcaattatacagaaataatatatgaattgcttgaagaatcacaaaaccagcaggaaaagaatgaacaagatttactagcattggacagatggaacagtctgtggaattggtttaacataacaaattggctgtggtatataaaaatattcataatgatagtaggaggcttgataggtttaagaataatttttgctgtgctttctttagtaaatagagttaggcagggatactcacctctgtcgttacagacccttatcccaagcccgaggggaccagacaggcccggaggaatcgaagaagaaggtggagagcaagacagaaacagatcaacgcgattagtgagcggattcttagcgcttgtctgggacgacctgcggagcctgtgccttttcatctaccaccgattgagagacttcatattaattgcagcgagagcgggggaacttctgggacgcagcagtctcaagggactacggagaggatgggaagcccttaagtatctgggaagtcttgtgcagtattggggcctggaactaaaaaggagtgctattagtctattggataccctagcaatagcagtaggtgaaggaacagataggattctagaatttgtattaggaatttgtagagctatccgcaacatacctacaagaataagacagggctttgaaacagctttgctataa

(The sequence listing continues in the following parts.)

What is claimed is:

1. A composition comprising a recombinant HIV-1 envelope protein comprising all consecutive amino acids immediately after the signal peptide in SEQ ID NO: 879 or SEQ ID NO: 861 and a carrier.

2. The composition according to claim 1 wherein said composition comprises a purified gp120 HIV-1 envelope protein consisting of all consecutive amino acids immediately after the signal peptide in SEQ ID NO: 879 or SEQ ID NO: 861.

3. The composition according to claim 1 wherein the recombinant HIV-1 envelope protein is a gp140 HIV-1 envelope protein.

4. The composition according to claim 1 wherein said composition further comprises an adjuvant.

5. The composition according to claim 1, wherein said composition comprises the recombinant HIV-1 envelope protein comprising all consecutive amino acids immediately after the signal peptide in SEQ ID NO: 879.

6. The composition according to claim 1, wherein said composition comprises the recombinant HIV-1 envelope protein comprising all consecutive amino acids immediately after the signal peptide in SEQ ID NO: 861.

7. The composition according to claim 2, wherein said composition comprises a purified gp120 HIV-1 envelope protein consisting of all consecutive amino acids immediately after the signal peptide in SEQ ID NO: 879.

8. The composition according to claim 2, wherein said composition comprises a purified gp120 HIV-1 envelope protein consisting of all consecutive amino acids immediately after the signal peptide in SEQ ID NO: 861.

9. The composition according to claim 7 wherein said composition further comprises an adjuvant.

10. The composition according to claim 8 wherein said composition further comprises an adjuvant.

11. A recombinant HIV-1 envelope protein comprising all consecutive amino acids immediately after the signal peptide in SEQ ID NO: 879 or SEQ ID NO: 861.

12. A method of inducing an immune response comprising administering to a mammal in need thereof the composition according to claim 1 in an amount sufficient to effect said induction.

13. The method according to claim 12 wherein the HIV-1 envelope protein is a purified gp120 HIV-1 envelope protein consisting of all consecutive amino acids immediately after the signal peptide in SEQ ID NO: 879 or SEQ ID NO: 861 and is administered as a prime in a prime/boost regimen.

14. The method according to claim 12 wherein said composition is administered by injection.

15. The method according to claim 12 wherein said composition is administered intrarectally or vaginally.

16. The method according to claim 12 wherein said mammal is a human.

17. The method of claim 12 further comprising administering a nucleic acid encoding CH505 TF HIV-1 envelope as a prime in a prime/boost regimen.

18. The method according to claim 13 further comprising administering a recombinant HIV-1 envelope protein comprising all the consecutive amino acids immediately after the signal peptide in SEQ ID NO: 884 or SEQ ID NO: 866 and a recombinant HIV-1 envelope protein comprising all consecutive amino acids immediately after the signal peptide in SEQ ID NO: 889 or SEQ ID NO: 871.

19. A method of inducing an immune response comprising administering to a mammal in need thereof the composition according to claim 9 in an amount sufficient to effect said induction.

20. A method of inducing an immune response comprising administering to a mammal in need thereof the composition according to claim 10 in an amount sufficient to effect said induction.

21. The method of claim 19 further comprising administering a recombinant HIV-1 envelope protein comprising all consecutive amino acids immediately after the signal peptide in SEQ ID NO: 884 or SEQ ID NO: 866 and a recombinant HIV-1 envelope protein comprising all consecutive amino acids immediately after the signal peptide in SEQ ID NO: 889 or SEQ ID NO: 871.

22. The method of claim 20 further comprising administering a recombinant HIV-1 envelope protein comprising all consecutive amino acids immediately after the signal peptide in SEQ ID NO: 884 or SEQ ID NO: 866 and a recombinant HIV-1 envelope protein comprising all consecutive amino acids immediately after the signal peptide in SEQ ID NO: 889 or SEQ ID NO: 871.

23. The method of claim 19 further comprising administering a nucleic acid encoding CH505 TF HIV-1 envelope as a prime in a prime/boost regimen.

24. The method of claim 20 further comprising administering a nucleic acid encoding CH505 TF HIV-1 envelope as a prime in a prime/boost regimen.

* * * * *